US012338275B2

(12) United States Patent
Kerr et al.

(10) Patent No.: US 12,338,275 B2
(45) Date of Patent: Jun. 24, 2025

(54) NON-VIRAL DNA VECTORS AND USES THEREOF FOR EXPRESSING FVIII THERAPEUTICS

(71) Applicant: Generation Bio Co., Cambridge, MA (US)

(72) Inventors: Douglas Anthony Kerr, Cambridge, MA (US); Debra Klatte, Cambridge, MA (US); Phillip Samayoa, Cambridge, MA (US); Nathaniel Silver, Cambridge, MA (US)

(73) Assignee: Generation Bio Co., Cambridge, MA (US)

( * ) Notice: Subject to any disclaimer, the term of this patent is extended or adjusted under 35 U.S.C. 154(b) by 885 days.

(21) Appl. No.: 17/437,123

(22) PCT Filed: Mar. 13, 2020

(86) PCT No.: PCT/US2020/022738

§ 371 (c)(1),
(2) Date: Sep. 8, 2021

(87) PCT Pub. No.: WO2020/186207

PCT Pub. Date: Sep. 17, 2020

(65) Prior Publication Data

US 2022/0177545 A1 Jun. 9, 2022

Related U.S. Application Data

(60) Provisional application No. 62/817,904, filed on Mar. 13, 2019, provisional application No. 62/856,432, filed on Jun. 3, 2019.

(51) Int. Cl.

*C12N 15/85* (2006.01)
*A61K 48/00* (2006.01)
*C07K 14/755* (2006.01)
*A61K 38/00* (2006.01)

(52) U.S. Cl.

CPC .......... *C07K 14/755* (2013.01); *A61K 48/005* (2013.01); *A61K 48/0075* (2013.01); *C12N 15/85* (2013.01); *A61K 38/00* (2013.01); *C12N 2750/14143* (2013.01); *C12N 2820/60* (2013.01)

(58) Field of Classification Search

None

See application file for complete search history.

(56) References Cited

U.S. PATENT DOCUMENTS

| | | | |
|---|---|---|---|
| 2010/0323957 A1 | 12/2010 | Kuriyan et al. | |
| 2017/0095538 A1* | 4/2017 | Colosi | C07K 14/755 |
| 2017/0096684 A1 | 4/2017 | Alton et al. | |
| 2017/0119906 A1 | 5/2017 | Riley | |
| 2019/0032083 A1 | 1/2019 | Kotin et al. | |

FOREIGN PATENT DOCUMENTS

| | | |
|---|---|---|
| NO | 2012/123430 A1 | 9/2012 |
| WO | 2010/125202 A1 | 11/2010 |
| WO | 2014/127215 A1 | 8/2014 |
| WO | 2015/038625 A1 | 3/2015 |
| WO | 2017/021359 A1 | 2/2017 |
| WO | 2017/053677 A1 | 3/2017 |
| WO | 2017/075619 A1 | 5/2017 |
| WO | 2017/152149 A1 | 9/2017 |
| WO | 2017/180857 A1 | 10/2017 |
| WO | 2019/028192 A1 | 2/2019 |
| WO | 2019/032898 A1 | 2/2019 |

OTHER PUBLICATIONS

International Search Report and Written Opinion for Application No. PCT/US2020/022738, dated Oct. 27, 2020, 13 pages.
International Preliminary Report on Patentability for Application No. PCT/US2020/022738, dated Sep. 23, 2021, 8 pages.
Li et al., Production and characterization of novel recombinant adeno-associated virus replicative-form genomes: a eukaryotic source of DNA for gene transfer. PLoS One. Aug. 1, 2013;8(8):e69879, 14 pages.

* cited by examiner

*Primary Examiner* — Ekaterina Poliakova-Georgantas
(74) *Attorney, Agent, or Firm* — McCarter & English, LLP; Marcie B. Clarke

(57) ABSTRACT

The application describes ceDNA vectors having linear and continuous structure for delivery and expression of a transgene. ceDNA vectors comprise an expression cassette flanked by two ITR sequences, where the expression cassette encodes a transgene encoding FVIII protein. Some ceDNA vectors further comprise cis-regulatory elements, including regulatory switches. Further provided herein are methods and cell lines for reliable gene expression of FVIII protein in vitro, ex vivo and in vivo using the ceDNA vectors. Provided herein are method and compositions comprising ceDNA vectors useful for the expression of FVIII protein in a cell, tissue or subject, and methods of treatment of diseases with said ceDNA vectors expressing FVIII protein. Such FVIII protein can be expressed for treating disease, e.g., hemophilia A.

17 Claims, 29 Drawing Sheets

Specification includes a Sequence Listing.

ITR-1, Left

NON-VIRAL DNA VECTORS AND USES THEREOF FOR EXPRESSING FVIII THERAPEUTICS

RELATED APPLICATIONS

This application is a 35 U.S.C. § 371 national stage filing of International Application No. PCT/US2020/022738, filed on Mar. 13, 2020, which claims priority to U.S. Provisional Application No. 62/817,904, filed on Mar. 13, 2019 and U.S. Provisional Application No. 62/856,432, filed on Jun. 3, 2019. The contents of each of the aforementioned applications are hereby incorporated by reference in their entireties.

SEQUENCE LISTING

The instant application contains a Sequence Listing, which has been submitted electronically in ASCII format, as well as sequences in Tables 1-9 herein, and each are hereby incorporated by reference in its entirety. Said ASCII copy, created on Jun. 3, 2020, is named 131698-06020_SL.txt and is 686,183 bytes in size.

TECHNICAL FIELD

The present invention relates to the field of gene therapy, including non-viral vectors for expressing a transgene or isolated polynucleotides in a subject or cell. The disclosure also relates to nucleic acid constructs, promoters, vectors, and host cells including the polynucleotides as well as methods of delivering exogenous DNA sequences to a target cell, tissue, organ or organism. For example, the present disclosure provides methods for using non-viral ceDNA vectors to express FVIII, from a cell, e.g., expressing the FVIII therapeutic protein for the treatment of a subject with a hemophilia A. The methods and compositions can be used e.g., for treating disease by expressing the FVIII in a cell or tissue of a subject in need thereof.

BACKGROUND

Gene therapy aims to improve clinical outcomes for patients suffering from either genetic mutations or acquired diseases caused by an aberration in the gene expression profile. Gene therapy includes the treatment or prevention of medical conditions resulting from defective genes or abnormal regulation or expression, e.g. underexpression or overexpression, that can result in a disorder, disease, malignancy, etc. For example, a disease or disorder caused by a defective gene might be treated, prevented or ameliorated by delivery of a corrective genetic material to a patient, or might be treated, prevented or ameliorated by altering or silencing a defective gene, e.g., with a corrective genetic material to a patient resulting in the therapeutic expression of the genetic material within the patient.

The basis of gene therapy is to supply a transcription cassette with an active gene product (sometimes referred to as a transgene), e.g., that can result in a positive gain-of-function effect, a negative loss-of-function effect, or another outcome. Such outcomes can be attributed to expression of a therapeutic protein such as an antibody, a functional enzyme, or a fusion protein. Gene therapy can also be used to treat a disease or malignancy caused by other factors. Human monogenic disorders can be treated by the delivery and expression of a normal gene to the target cells. Delivery and expression of a corrective gene in the patient's target cells can be carried out via numerous methods, including the use of engineered viruses and viral gene delivery vectors. Among the many virus-derived vectors available (e.g., recombinant retrovirus, recombinant lentivirus, recombinant adenovirus, and the like), recombinant adeno-associated virus (rAAV) is gaining popularity as a versatile vector in gene therapy.

Adeno-associated viruses (AAV) belong to the Parvoviridae family and more specifically constitute the dependoparvovirus genus. Vectors derived from AAV (i.e., recombinant AAV (rAVV) or AAV vectors) are attractive for delivering genetic material because (i) they are able to infect (transduce) a wide variety of non-dividing and dividing cell types including myocytes and neurons; (ii) they are devoid of the virus structural genes, thereby diminishing the host cell responses to virus infection, e.g., interferon-mediated responses; (iii) wild-type viruses are considered non-pathologic in humans; (iv) in contrast to wild type AAV, which are capable of integrating into the host cell genome, replication-deficient AAV vectors lack the rep gene and generally persist as episomes, thus limiting the risk of insertional mutagenesis or genotoxicity; and (v) in comparison to other vector systems, AAV vectors are generally considered to be relatively poor immunogens and therefore do not trigger a significant immune response (see ii), thus gaining persistence of the vector DNA and potentially, long-term expression of the therapeutic transgenes.

However, there are several major deficiencies in using AAV particles as a gene delivery vector. One major drawback associated with rAAV is its limited viral packaging capacity of about 4.5 kb of heterologous DNA (Dong et al., 1996; Athanasopoulos et al., 2004; Lai et al., 2010), and as a result, use of AAV vectors has been limited to less than 150,000 Da protein coding capacity. The second drawback is that as a result of the prevalence of wild-type AAV infection in the population, candidates for rAAV gene therapy have to be screened for the presence of neutralizing antibodies that eliminate the vector from the patient. A third drawback is related to the capsid immunogenicity that prevents re-administration to patients that were not excluded from an initial treatment. The immune system in the patient can respond to the vector which effectively acts as a "booster" shot to stimulate the immune system generating high titer anti-AAV antibodies that preclude future treatments. Some recent reports indicate concerns with immunogenicity in high dose situations. Another notable drawback is that the onset of AAV-mediated gene expression is relatively slow, given that single-stranded AAV DNA must be converted to double-stranded DNA prior to heterologous gene expression.

Additionally, conventional AAV virions with capsids are produced by introducing a plasmid or plasmids containing the AAV genome, rep genes, and cap genes (Grimm et al., 1998). However, such encapsidated AAV virus vectors were found to inefficiently transduce certain cell and tissue types and the capsids also induce an immune response.

Accordingly, use of adeno-associated virus (AAV) vectors for gene therapy is limited due to the single administration to patients (owing to the patient immune response), the limited range of transgene genetic material suitable for delivery in AAV vectors due to minimal viral packaging capacity (about 4.5 kb), and slow AAV-mediated gene expression.

There is large unmet need for disease-modifying therapies in hemophilia A. Current therapies are burdensome and require intravenous (IV) administrations. First, these Factor VIII injectables do not provide continuous delivery of factors, with trough levels allowing bleeding episodes. Second, there are no approved gene therapies for hemophilia A, and AAV based therapies cannot be used by 25% to 40% of patients due to pre-existing antibodies. AAV can only be administered once, and the resulting Factor VIII levels might not be high enough to be efficacious, or may be supranormal, dose levels cannot be titrated. Third, many hemophilia A patients cannot utilize these therapies because of the development of neutralizing antibodies to these exogenous, artificial clotting factors.

Accordingly, there is need in the field for a technology that permits expression of a therapeutic FVIII protein in a cell, tissue or subject for the treatment of hemophilia A.

BRIEF DESCRIPTION

The technology described herein relates to methods and compositions for treatment of Hemophilia A by expression of Factor VIII (FVIII) protein from a capsid-free (e.g., non-viral) DNA vector with covalently-closed ends (referred to herein as a "closed-ended DNA vector" or a "ceDNA vector"), where the ceDNA vector comprises a FVIII nucleic acid sequence or codon optimized versions thereof. These ceDNA vector can be used to produce FVIII proteins for treatment, monitoring, and diagnosis. The application of ceDNA vectors expressing FVIII to the subject for the treatment of hemophilia A is useful to: (i) provide disease modifying levels of FVIII enzyme, (ii) be minimally invasive in delivery, (iii) be repeatable and dosed-to-effect, (iv) have rapid onset of therapeutic effect, (v) result in sustained expression of corrective FVIII enzyme in the liver, (vi) restore urea cycle function, and/or (vii) be titratable to achieve the appropriate pharmacologic levels of the defective enzyme.

In some embodiments, a ceDNA-vector expressing FVIII is optionally present in a liposome nanoparticle formulation (LNP) to the treatment of hemophilia A. The ceDNA vectors described herein can provide one or more benefits including, but not limited to providing disease modifying levels of Factor VIII, being minimally invasive in delivery, being repeatable and dosed-to-effect, providing a rapid onset of therapeutic effect, within days of therapeutic intervention, sustained expression of corrective Factor VIII levels in the circulation, be titratable to achieve the appropriate pharmacologic levels of the defective coagulation factor, and/or provide treatments for other hemophilia, including but not limited to Factor VIII deficiency.

Accordingly, the invention described herein relates to a capsid-free (e.g., non-viral) DNA vector with covalently-closed ends (referred to herein as a "closed-ended DNA vector" or a "ceDNA vector") comprising a heterogeneous gene encoding FVIII, to permit expression of the FVIII therapeutic protein in a cell. According to one aspect, the disclosure provides a capsid-free close-ended DNA (ceDNA) vector comprising at least one heterologous nucleotide sequence between flanking inverted terminal repeats (ITRs), wherein at least one heterologous nucleotide sequence encodes at least one FVIII protein, wherein the least one heterologous nucleotide sequence that encodes at least one FVIII protein is selected from any of the sequences in Table 1. According to some embodiments, the ceDNA vector comprises a nucleic acid sequence selected from any of those in Table 9. According to some embodiments, the ceDNA vector comprises a nucleic acid sequence selected from the group consisting of SEQ ID NO: 207, SEQ ID NO: 210, SEQ ID NO: 212, SEQ ID NO: 199, SEQ ID NO: 208, SEQ ID NO: 211 and SEQ ID NO: 214. According to some embodiments, the ceDNA vector comprises a nucleic acid sequence that is at least 85% identical to SEQ ID NO: 210. According to some embodiments, the ceDNA vector comprises a nucleic acid sequence that is at least 90% identical to SEQ ID NO: 210. According to some embodiments, the ceDNA vector comprises a nucleic acid sequence that is at least 95% identical to SEQ ID NO: 210. According to some embodiments, the ceDNA vector comprises a nucleic acid sequence that is at least 96% identical to SEQ ID NO: 210. According to some embodiments, the ceDNA vector comprises a nucleic acid sequence that is at least 97% identical to SEQ ID NO: 210. According to some embodiments, the ceDNA vector comprises a nucleic acid sequence that is at least 98% identical to SEQ ID NO: 210. According to some embodiments, the ceDNA vector comprises a nucleic acid sequence that is at least 99% identical to SEQ ID NO: 210. According to some embodiments, the ceDNA vector comprises a nucleic acid sequence that is at least 85% identical to SEQ ID NO: 214. According to some embodiments, the ceDNA vector comprises a nucleic acid sequence that is at least 90% identical to SEQ ID NO: 214. According to some embodiments, the ceDNA vector comprises a nucleic acid sequence that is at least 95% identical to SEQ ID NO: 214. According to some embodiments, the ceDNA vector comprises a nucleic acid sequence that is at least 96% identical to SEQ ID NO: 214. According to some embodiments, the ceDNA vector comprises a nucleic acid sequence that is at least 97% identical to SEQ ID NO: 214. According to some embodiments, the ceDNA vector comprises a nucleic acid sequence that is at least 98% identical to SEQ ID NO: 214. According to some embodiments, the ceDNA vector comprises a nucleic acid sequence that is at least 99% identical to SEQ ID NO: 214.

In one embodiment, disclosed herein is a capsid-free close-ended DNA (ceDNA) vector comprising at least one heterologous nucleotide sequence between flanking inverted terminal repeats (ITRs), wherein at least one heterologous nucleotide sequence encodes at least one FVIII protein, wherein the least one heterologous nucleotide sequence that encodes at least one FVIII protein is selected from a sequence having at least 85% identity to any sequence in Table 1. In one embodiment, the least one heterologous nucleotide sequence that encodes at least one FVIII protein is selected from a sequence having at least 90% identity to any sequence in Table 1. In one embodiment, the least one heterologous nucleotide sequence that encodes at least one FVIII protein is selected from a sequence having at least 91% identity to any sequence in Table 1. In one embodiment, the least one heterologous nucleotide sequence that encodes at least one FVIII protein is selected from a sequence having at least 92% identity to any sequence in Table 1. In one embodiment, the least one heterologous nucleotide sequence that encodes at least one FVIII protein is selected from a sequence having at least 93% identity to any sequence in Table 1. In one embodiment, the least one heterologous nucleotide sequence that encodes at least one FVIII protein is selected from a sequence having at least 94% identity to any sequence in Table 1. In one embodiment, the least one heterologous nucleotide sequence that encodes at least one FVIII protein is selected from a sequence having at least 95% identity to any sequence in Table 1. In one embodiment, the least one heterologous nucleotide sequence that encodes at least one FVIII protein is selected from a sequence having at least 96% identity to any sequence in Table 1. In one embodiment, the least one heterologous nucleotide sequence that encodes at least one FVIII protein is selected from a sequence having at least 97% identity to any sequence in Table 1. In one embodiment, the least one heterologous nucleotide sequence that encodes at least one FVIII protein is selected from a sequence having at least 98% identity to any sequence in Table 1. In one embodiment, the least one heterologous nucleotide sequence that encodes at least one FVIII protein is selected from a sequence having at least 99% identity to any sequence in Table 1. In one embodiment, the least one heterologous nucleotide sequence that encodes at least one FVIII protein is selected from a sequence comprising any sequence in Table 1. In one embodiment, the least one heterologous nucleotide sequence that encodes at least one FVIII protein is selected from a sequence consisting of any sequence in Table 1.

In one embodiment, the sequence in Table 1 is selected from the group consisting of SEQ ID NO:380, SEQ ID NO:381, SEQ ID NO:382, SEQ ID NO:383, SEQ ID NO:384, SEQ ID NO:385, SEQ ID NO:386, SEQ ID NO:387, SEQ ID NO:388, SEQ ID NO:389, SEQ ID NO:390, SEQ ID NO:391, SEQ ID NO:392, SEQ ID NO:393, SEQ ID NO:394, SEQ ID NO:395, SEQ ID NO:396, and SEQ ID NO:397. In one embodiment, the sequence is SEQ ID NO: 380. In one embodiment, the sequence is SEQ ID NO:381. In one embodiment, the sequence is SEQ ID NO:382. In one embodiment, the sequence is SEQ ID NO:383. In one embodiment, the sequence is SEQ ID NO:384. In one embodiment, the sequence is SEQ ID NO:385. In one embodiment, the sequence is SEQ ID NO:386. In one embodiment, the sequence is SEQ ID NO:387. In one embodiment, the sequence is SEQ ID NO:388. In one embodiment, the sequence is SEQ ID NO:389. In one embodiment, the sequence is SEQ ID NO:390. In one embodiment, the sequence is SEQ ID NO:391. In one embodiment, the sequence is SEQ ID NO:392. In one embodiment, the sequence is SEQ ID NO:393. In one embodiment, the sequence is SEQ ID NO:394. In one embodiment, the sequence is SEQ ID NO:395. In one embodiment, the sequence is SEQ ID NO:396. In one embodiment, the sequence is SEQ ID NO:397.

In one embodiment, the ceDNA vector comprises a nucleic acid sequence selected from a sequence having at least 85% identity with any sequence in Table 9. In one embodiment, the ceDNA vector comprises a nucleic acid sequence selected from a sequence having at least 90% identity with any sequence in Table 9. In one embodiment, the ceDNA vector comprises a nucleic acid sequence selected from a sequence having at least 91% identity with any sequence in Table 9. In one embodiment, the ceDNA vector comprises a nucleic acid sequence selected from a sequence having at least 92% identity with any sequence in Table 9. In one embodiment, the ceDNA vector comprises a nucleic acid sequence selected from a sequence having at least 93% identity with any sequence in Table 9. In one embodiment, the ceDNA vector comprises a nucleic acid sequence selected from a sequence having at least 94% identity with any sequence in Table 9. In one embodiment, the ceDNA vector comprises a nucleic acid sequence selected from a sequence having at least 95% identity with any sequence in Table 9. In one embodiment, the ceDNA vector comprises a nucleic acid sequence selected from a sequence having at least 96% identity with any sequence in Table 9. In one embodiment, the ceDNA vector comprises a nucleic acid sequence selected from a sequence having at least 97% identity with any sequence in Table 9. In one embodiment, the ceDNA vector comprises a nucleic acid sequence selected from a sequence having at least 98% identity with any sequence in Table 9. In one embodiment, the ceDNA vector comprises a nucleic acid sequence selected from a sequence having at least 99% identity with any sequence in Table 9. In one embodiment, the ceDNA vector comprises a nucleic acid sequence comprising a sequence in Table 9. In one embodiment, the ceDNA vector comprises a nucleic acid sequence consisting of a sequence in Table 9.

In one embodiment, the sequence in Table 9 is selected from the group consisting of SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, and SEQ ID NO:217. In one embodiment, the sequence in Table 9 is SEQ ID NO:197. In one embodiment, the sequence in Table 9 is SEQ ID NO:198. In one embodiment, the sequence in Table 9 is SEQ ID NO:199. In one embodiment, the sequence in Table 9 is 200. In one embodiment, the sequence in Table 9 is 201. In one embodiment, the sequence in Table 9 is 202. In one embodiment, the sequence in Table 9 is 203. In one embodiment, the sequence in Table 9 is 204. In one embodiment, the sequence in Table 9 is 205. In one embodiment, the sequence in Table 9 is 206. In one embodiment, the sequence in Table 9 is 207. In one embodiment, the sequence in Table 9 is 208. In one embodiment, the sequence in Table 9 is 209. In one embodiment, the sequence in Table 9 is 210. In one embodiment, the sequence in Table 9 is 211. In one embodiment, the sequence in Table 9 is 212. In one embodiment, the sequence in Table 9 is 213. In one embodiment, the sequence in Table 9 is 214. In one embodiment, the sequence in Table 9 is 215. In one embodiment, the sequence in Table 9 is 216. In one embodiment, the sequence in Table 9 is 217.

In one embodiment, the ceDNA vector comprises a nucleic acid sequence having at least 85% identity to SEQ ID NO:210. In one embodiment, the ceDNA vector comprises a nucleic acid sequence having at least 90% identity to SEQ ID NO:210. In one embodiment, the ceDNA vector comprises a nucleic acid sequence having at least 91% identity to SEQ ID NO:210. In one embodiment, the ceDNA vector comprises a nucleic acid sequence having at least 92% identity to SEQ ID NO:210. In one embodiment, the ceDNA vector comprises a nucleic acid sequence having at least 93% identity to SEQ ID NO:210. In one embodiment, the ceDNA vector comprises a nucleic acid sequence having at least 94% identity to SEQ ID NO:210. In one embodiment, the ceDNA vector comprises a nucleic acid sequence having at least 95% identity to SEQ ID NO:210. In one embodiment, the ceDNA vector comprises a nucleic acid sequence having at least 96% identity to SEQ ID NO:210. In one embodiment, the ceDNA vector comprises a nucleic acid sequence having at least 97% identity to SEQ ID NO:210. In one embodiment, the ceDNA vector comprises a nucleic acid sequence having at least 98% identity to SEQ ID NO:210. In one embodiment, the ceDNA vector comprises a nucleic acid sequence having at least 99% identity to SEQ ID NO:210. In one embodiment, the ceDNA vector comprises a nucleic acid sequence comprising SEQ ID NO:210. In one embodiment, the ceDNA vector comprises a nucleic acid sequence consisting of SEQ ID NO:210.

In one embodiment, the ceDNA vector comprises a nucleic acid sequence having at least 85% identity to SEQ ID NO:214. In one embodiment, the ceDNA vector comprises a nucleic acid sequence having at least 90% identity to SEQ ID NO:214. In one embodiment, the ceDNA vector comprises a nucleic acid sequence having at least 91% identity to SEQ ID NO:214. In one embodiment, the ceDNA vector comprises a nucleic acid sequence having at least 92% identity to SEQ ID NO:214. In one embodiment, the ceDNA vector comprises a nucleic acid sequence having at least 93% identity to SEQ ID NO:214. In one embodiment, the ceDNA vector comprises a nucleic acid sequence having at least 94% identity to SEQ ID NO:214. In one embodiment, the ceDNA vector comprises a nucleic acid sequence having at least 95% identity to SEQ ID NO:214. In one embodiment, the ceDNA vector comprises a nucleic acid sequence having at least 96% identity to SEQ ID NO:214. In one embodiment, the ceDNA vector comprises a nucleic acid sequence having at least 97% identity to SEQ ID NO:214. In one embodiment, the ceDNA vector comprises a nucleic acid sequence having at least 98% identity to SEQ ID NO:214. In one embodiment, the ceDNA vector comprises a nucleic acid sequence having at least 99% identity to SEQ ID NO:214. In one embodiment, the ceDNA vector comprises a nucleic acid sequence comprising SEQ ID NO:214. In one embodiment, the ceDNA vector comprises a nucleic acid sequence consisting of SEQ ID NO:214.

The ceDNA vectors for expression of FVIII protein production as described herein are capsid-free, linear duplex DNA molecules formed from a continuous strand of complementary DNA with covalently-closed ends (linear, continuous and non-encapsidated structure), which comprise a 5' inverted terminal repeat (ITR) sequence and a 3' ITR sequence, where the 5' ITR and the 3' ITR can have the same symmetrical three-dimensional organization with respect to each other, (i.e., symmetrical or substantially symmetrical), or alternatively, the 5' ITR and the 3' ITR can have different three-dimensional organization with respect to each other (i.e., asymmetrical ITRs). In addition, the ITRs can be from the same or different serotypes. In some embodiments, a ceDNA vector can comprise ITR sequences that have a symmetrical three-dimensional spatial organization such that their structure is the same shape in geometrical space, or have the same A, C-C' and B-B' loops in 3D space (i.e., they are the same or are mirror images with respect to each other). In some embodiments, one ITR can be from one AAV serotype, and the other ITR can be from a different AAV serotype.

Accordingly, some aspects of the technology described herein relate to a ceDNA vector for improved protein expression and/or production of the above described FVIII protein that comprise ITR sequences that flank a heterologous nucleic acid sequence comprising any FVIII nucleic acid sequence disclosed in Tables 5, the ITR sequences being selected from any of: (i) at least one WT ITR and at least one modified AAV inverted terminal repeat (ITR) (e.g., asymmetric modified ITRs); (ii) two modified ITRs where the mod-ITR pair have a different three-dimensional spatial organization with respect to each other (e.g., asymmetric modified ITRs), or (iii) symmetrical or substantially symmetrical WT-WT ITR pair, where each WT-ITR has the same three-dimensional spatial organization, or (iv) symmetrical or substantially symmetrical modified ITR pair, where each mod-ITR has the same three-dimensional spatial organization. The ceDNA vectors disclosed herein can be produced in eukaryotic cells, thus devoid of prokaryotic DNA modifications and bacterial endotoxin contamination in insect cells.

The methods and compositions described herein relate, in part, to the discovery of a non-viral capsid-free DNA vector with covalently-closed ends (ceDNA vectors) that can be used to express at least one FVIII protein, or more than one FVIII protein from a cell, including but not limited to cells of the liver.

Accordingly, provided herein in one aspect are DNA vectors (e.g., ceDNA vectors) comprising at least one heterologous nucleic acid sequence encoding at least one transgene encoding FVIII proteins thereof operably linked to a promoter positioned between two different AAV inverted terminal repeat sequences (ITRs), one of the ITRS comprising a functional AAV terminal resolution site and a Rep binding site, and one of the ITRs comprising a deletion, insertion, or substitution relative to the other ITR; wherein the transgene encodes an FVIII protein; and wherein the DNA when digested with a restriction enzyme having a single recognition site on the DNA vector has the presence of characteristic bands of linear and continuous DNA as compared to linear and non-continuous DNA controls when analyzed on a non-denaturing gel. Other aspects include delivery of the FVIII protein by expressing it in vivo from a ceDNA vector as described herein and further, the treatment of hemophilia A using ceDNA vectors encoding the FVIII. Also contemplated herein are cells comprising a ceDNA vector encoding FVIII as described herein. According to some embodiments, the ceDNA vector is selected from the group consisting of ceDNAFVIII-vector 16, ceDNAFVIII-vector 19, ceDNAFVIII-vector 21, ceDNAFVIII-vector 8, ceDNAFVIII-vector 17, ceDNAFVIII-vector 20 and ceDNAFVIII-vector 23. According to some embodiments, the ceDNA vector is ceDNAFVIII vector 19 or ceDNAFVIII vector 23.

Aspects of the invention relate to methods to produce the ceDNA vectors useful for FVIII protein expression in a cell as described herein. Other embodiments relate to a ceDNA vector produced by the method provided herein. In one embodiment, the capsid free (e.g., non-viral) DNA vector (ceDNA vector) for FVIII protein production is obtained from a plasmid (referred to herein as a "ceDNA-plasmid") comprising a polynucleotide expression construct template comprising in this order: a first 5' inverted terminal repeat (e.g. AAV ITR); a heterologous nucleic acid sequence; and a 3' ITR (e.g. AAV ITR), where the 5' ITR and 3'ITR can be asymmetric relative to each other, or symmetric (e.g., WT-ITRs or modified symmetric ITRs) as defined herein. According to some embodiments, the ceDNA vector is selected from the group consisting of ceDNAFVIII-vector 16, ceDNAFVIII-vector 19, ceDNAFVIII-vector 21, ceDNAFVIII-vector 8, ceDNAFVIII-vector 17, ceDNAFVIII-vector 20 and ceDNAFVIII-vector 23. According to some embodiments, the ceDNA vector is ceDNAFVIII vector 19 or ceDNAFVIII vector 23.

The ceDNA vector for expression of the FVIII protein as disclosed herein is obtainable by a number of means that would be known to the ordinarily skilled artisan after reading this disclosure. For example, a polynucleotide expression construct template used for generating the ceDNA vectors of the present invention can be a ceDNA-plasmid, a ceDNA-bacmid, and/or a ceDNA-baculovirus. In one embodiment, the ceDNA-plasmid comprises a restriction cloning site (e.g. SEQ ID NO: 123 and/or 124) operably positioned between the ITRs where an expression cassette comprising e.g., a promoter operatively linked to a transgene, e.g., a nucleic acid encoding FVIII can be inserted. In some embodiments, ceDNA vectors for expression of FVIII protein are produced from a polynucleotide template (e.g., ceDNA-plasmid, ceDNA-bacmid, ceDNA-baculovirus) containing symmetric or asymmetric ITRs (modified or WT ITRs).

In a permissive host cell, in the presence of e.g., Rep, the polynucleotide template having at least two ITRs replicates to produce ceDNA vectors expressing the FVIII protein. ceDNA vector production undergoes two steps: first, excision ("rescue") of template from the template backbone (e.g. ceDNA-plasmid, ceDNA-bacmid, ceDNA-baculovirus genome etc.) via Rep proteins, and second, Rep mediated replication of the excised ceDNA vector. Rep proteins and Rep binding sites of the various AAV serotypes are well known to those of ordinary skill in the art. One of ordinary skill understands to choose a Rep protein from a serotype that binds to and replicates the nucleic acid sequence based upon at least one functional ITR. For example, if the replication competent ITR is from AAV serotype 2, the corresponding Rep would be from an AAV serotype that works with that serotype such as AAV2 ITR with AAV2 or AAV4 Rep but not AAV5 Rep, which does not. Upon replication, the covalently-closed ended ceDNA vector continues to accumulate in permissive cells and ceDNA vector is preferably sufficiently stable over time in the presence of Rep protein under standard replication conditions, e.g. to accumulate in an amount that is at least 1 pg/cell, preferably at least 2 pg/cell, preferably at least 3 pg/cell, more preferably at least 4 pg/cell, even more preferably at least 5 pg/cell.

Accordingly, one aspect of the invention relates to a process of producing a ceDNA vector for expression of such FVIII proteins comprising the steps of: a) incubating a population of host cells (e.g. insect cells) harboring the polynucleotide expression construct template (e.g., a ceDNA-plasmid, a ceDNA-bacmid, and/or a ceDNA-baculovirus), which is devoid of viral capsid coding sequences, in the presence of a Rep protein under conditions effective and for a time sufficient to induce production of the ceDNA vector within the host cells, and wherein the host cells do not comprise viral capsid coding sequences; and b) harvesting and isolating the ceDNA vector from the host cells. The presence of Rep protein induces replication of the vector polynucleotide with a modified ITR to produce the ceDNA vector for expression of FVIII protein in a host cell. However, no viral particles (e.g. AAV virions) are expressed. Thus, there is no virion-enforced size limitation. According to some embodiments, the ceDNA vector is selected from the group consisting of ceDNAFVIII-vector 16, ceDNAFVIII-vector 19, ceDNAFVIII-vector 21, ceDNAFVIII-vector 8, ceDNAFVIII-vector 17, ceDNAFVIII-vector 20 and ceDNAFVIII-vector 23. According to some embodiments, the ceDNA vector is ceDNAFVIII vector 19 or ceDNAFVIII vector 23.

The presence of the ceDNA vector useful for expression of FVIII protein is isolated from the host cells can be confirmed by digesting DNA isolated from the host cell with a restriction enzyme having a single recognition site on the ceDNA vector and analyzing the digested DNA material on denaturing and non-denaturing gels to confirm the presence of characteristic bands of linear and continuous DNA as compared to linear and non-continuous DNA.

Also provided herein are methods of expressing an FVIII protein that has therapeutic uses, using a ceDNA vector in a cell or subject. Such FVIII proteins can be used for the treatment of hemophilia A. Accordingly, provided herein are methods for the treatment of hemophilia A comprising administering a ceDNA vector encoding a therapeutic FVIII protein to a subject in need thereof. According to some embodiments, the ceDNA vector encoding a therapeutic FVIII protein is selected from the group consisting of ceDNAFVIII-vector 16, ceDNAFVIII-vector 19, ceDNAFVIII-vector 21, ceDNAFVIII-vector 8, ceDNAFVIII-vector 17, ceDNAFVIII-vector 20 and ceDNAFVIII-vector 23. According to some embodiments, the ceDNA vector is ceDNAFVIII vector 19 or ceDNAFVIII vector 23. According to some embodiments, levels of FVIII in the serum of the subject are increased in subjects administered the ceDNA vector compared to a control. According to some embodiments, the increase in levels of FVIII is greater than about 40% compared to the control. According to some embodiments, the increase in levels of FVIII is greater than about 40%, about 45%, about 50%, about 55%, about 60%, about 65%, about 70%, about 75% compared to the control.

In some embodiments, one aspect of the technology described herein relates to a non-viral capsid-free DNA vector with covalently-closed ends (ceDNA vector), wherein the ceDNA vector comprises at least one heterologous nucleotide sequence, operably positioned between two inverted terminal repeat sequences where the ITR sequences can be asymmetric, or symmetric, or substantially symmetrical as these terms are defined herein, wherein at least one of the ITRs comprises a functional terminal resolution site and a Rep binding site, and optionally the heterologous nucleic acid sequence encodes a transgene (e.g., FVIII protein) and wherein the vector is not in a viral capsid.

These and other aspects of the invention are described in further detail below.

DESCRIPTION OF DRAWINGS

Embodiments of the present disclosure, briefly summarized above and discussed in greater detail below, can be understood by reference to the illustrative embodiments of the disclosure depicted in the appended drawings. However, the appended drawings illustrate only typical embodiments of the disclosure and are therefore not to be considered limiting of scope, for the disclosure may admit to other equally effective embodiments.

FIG. 4D shows schematic expected bands for an exemplary ceDNA either left uncut or digested with a restriction endonuclease and then subjected to electrophoresis on either a native gel or a denaturing gel. The leftmost schematic is a native gel, and shows multiple bands suggesting that in its duplex and uncut form ceDNA exists in at least monomeric and dimeric states, visible as a faster-migrating smaller monomer and a slower-migrating dimer that is twice the size of the monomer. The schematic second from the left shows that when ceDNA is cut with a restriction endonuclease, the original bands are gone and faster-migrating (e.g., smaller) bands appear, corresponding to the expected fragment sizes remaining after the cleavage. Under denaturing conditions, the original duplex DNA is single-stranded and migrates as a species twice as large as observed on native gel because the complementary strands are covalently linked. Thus, in the second schematic from the right, the digested ceDNA shows a similar banding distribution to that observed on native gel, but the bands migrate as fragments twice the size of their native gel counterparts. The rightmost schematic shows that uncut ceDNA under denaturing conditions migrates as a single-stranded open circle, and thus the observed bands are twice the size of those observed under native conditions where the circle is not open. In this figure "kb" is used to indicate relative size of nucleotide molecules based, depending on context, on either nucleotide chain length (e.g., for the single stranded molecules observed in denaturing conditions) or number of base pairs (e.g., for the double-stranded molecules observed in native conditions). FIG. 4E shows DNA having a non-continuous structure. The ceDNA can be cut by a restriction endonuclease, having a single recognition site on the ceDNA vector, and generate two DNA fragments with different sizes (1 kb and 2 kb) in both neutral and denaturing conditions. FIG. 4E also shows a ceDNA having a linear and continuous structure. The ceDNA vector can be cut by the restriction endonuclease and generate two DNA fragments that migrate as 1 kb and 2 kb in neutral conditions, but in denaturing conditions, the stands remain connected and produce single strands that migrate as 2 kb and 4 kb.

FIG. 8A shows representative IVIS images from JetPEI®-ceDNA-Luciferase-injected rat eyes (upper left) versus uninjected eye in the same rat (upper right) or plasmid-Luciferase DNA-injected rat eye (lower left) and the uninjected eye in that same rat (lower right). FIG. 8B shows a graph of the average radiance observed in treated eyes or the corresponding untreated eyes in each of the treatment groups. The ceDNA-treated rats demonstrated prolonged significant fluorescence (and hence luciferase transgene expression) over 99 days, in sharp contrast to rats treated with plasmid-luciferase where minimal relative fluorescence (and hence luciferase transgene expression) was observed.

FIG. 9A shows a graph of total flux over time observed in LNP-ceDNA-Luc-treated wild-type c57bl/6 mice or Rag2 mice. FIG. 9B provides a graph showing the impact of redose on expression levels of the luciferase transgene in Rag2 mice, with resulting increased stable expression observed after redose (arrow indicates time of redose administration).

FIG. 11A shows FVIII expression levels in serum samples at day 3 and 7 from mice after hydrodynamic injection of three different ceDNA vectors expressing FVIII (LPS1-F8-v1; LPS1-F8-v2; LPS1-F8-v3), or a control ceDNA vector (a ceDNA expressing luciferase only) (shown as Vehicle). Two of the three ceDNA vectors expressing FVIII showed FVIII expression. FIG. 11B is a dose-response graph of FVIII expression levels in serum samples over a 30 day period of from mice after hydrodynamic injection with either low or high amounts of the three different ceDNA vectors expressing FVIII (LPS1-F8-v1; LPS1-F8-v2; LPS1-F8-v3), or high amounts of the vehicle control ceDNA vector (expressing luciferase only).

As shown in FIG. 15, plasma FVIII increased in a dose-dependent manner with increasing dosage of ceDNAFVIII-vector 23. Vehicle only was used as control.

DETAILED DESCRIPTION OF THE INVENTION

Figure 1A:
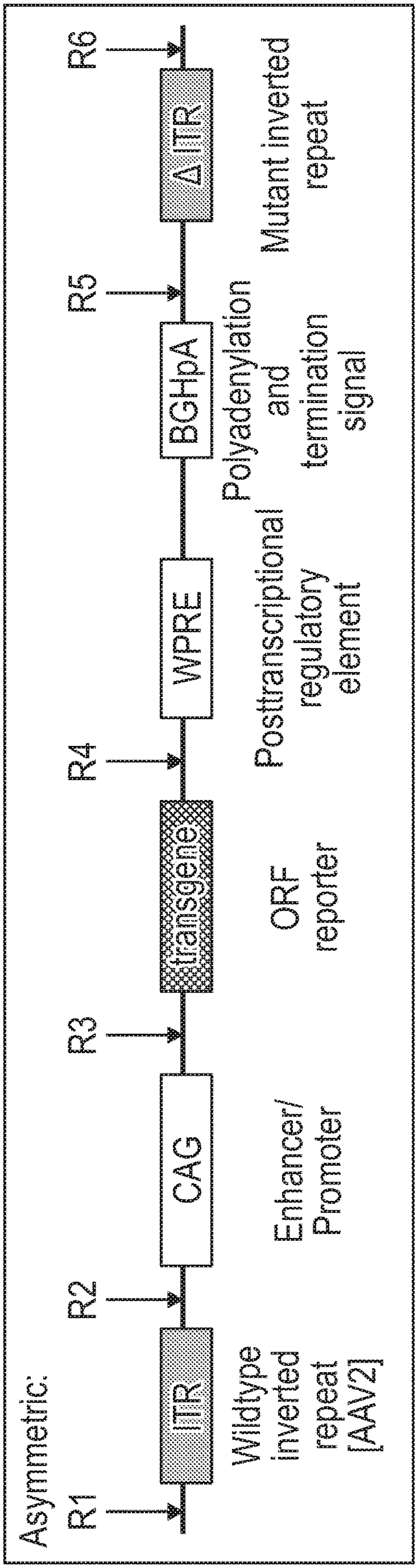
FIG. 1A illustrates an exemplary structure of a ceDNA vector for expression of an FVIII protein as disclosed herein, comprising asymmetric ITRs. In this embodiment, the exemplary ceDNA vector comprises an expression cassette containing CAG promoter, WPRE, and BGHpA. An open reading frame (ORF) encoding the FVIII transgene can be inserted into the cloning site (R3/R4) between the CAG promoter and WPRE. The expression cassette is flanked by two inverted terminal repeats (ITRs)—the wild-type AAV2 ITR on the upstream (5'-end) and the modified ITR on the downstream (3'-end) of the expression cassette, therefore the two ITRs flanking the expression cassette are asymmetric with respect to each other.

Provided herein is a method for treating hemophilia A using a ceDNA vector comprising one or more nucleic acids that encode an FVIII therapeutic protein or fragment thereof. Also provided herein are ceDNA vectors for expression of FVIII protein as described herein comprising one or more heterologous nucleic acids that encode for the FVIII protein. In some embodiments, the expression of FVIII protein can comprise secretion of the therapeutic protein out of the cell in which it is expressed. Alternatively, in some embodiments, the expressed FVIII protein can act or function (e.g., exert its effect) within the cell in which it is expressed. In some embodiments, the ceDNA vector expresses FVIII protein in the liver, a muscle (e.g., skeletal muscle) of a subject, or other body part, which can act as a depot for FVIII therapeutic protein production and secretion to many systemic compartments.

I. Definitions

Unless otherwise defined herein, scientific and technical terms used in connection with the present application shall have the meanings that are commonly understood by those of ordinary skill in the art to which this disclosure belongs. It should be understood that this invention is not limited to the particular methodology, protocols, and reagents, etc., described herein and as such can vary. The terminology used herein is for the purpose of describing particular embodiments only and is not intended to limit the scope of the present invention, which is defined solely by the claims. Definitions of common terms in immunology and molecular biology can be found in The Merck Manual of Diagnosis and Therapy, 19th Edition, published by Merck Sharp & Dohme Corp., 2011 (ISBN 978-0-911910-19-3); Robert S. Porter et al. (eds.), Fields Virology, $6^{th}$ Edition, published by Lippincott Williams & Wilkins, Philadelphia, PA, USA (2013), Knipe, D. M. and Howley, P. M. (ed.), The Encyclopedia of Molecular Cell Biology and Molecular Medicine, published by Blackwell Science Ltd., 1999-2012 (ISBN 9783527600908); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006; Janeway's Immunobiology, Kenneth Murphy, Allan Mowat, Casey Weaver (eds.), Taylor & Francis Limited, 2014 (ISBN 0815345305, 9780815345305); Lewin's Genes XI, published by Jones & Bartlett Publishers, 2014 (ISBN-1449659055); Michael Richard Green and Joseph Sambrook, Molecular Cloning: A Laboratory Manual, $4^{th}$ ed., Cold Spring Harbor Laboratory Press, Cold Spring Harbor, N.Y., USA (2012) (ISBN 1936113414); Davis et al., Basic Methods in Molecular Biology, Elsevier Science Publishing, Inc., New York, USA (2012) (ISBN 044460149X); Laboratory Methods in Enzymology: DNA, Jon Lorsch (ed.) Elsevier, 2013 (ISBN 0124199542); Current Protocols in Molecular Biology (CPMB), Frederick M. Ausubel (ed.), John Wiley and Sons, 2014 (ISBN047150338X, 9780471503385), Current Protocols in Protein Science (CPPS), John E. Coligan (ed.), John Wiley and Sons, Inc., 2005; and Current Protocols in Immunology (CPI) (John E. Coligan, A D A M Kruisbeek, David H Margulies, Ethan M Shevach, Warren Strobe, (eds.) John Wiley and Sons, Inc., 2003 (ISBN 0471142735, 9780471142737), the contents of which are all incorporated by reference herein in their entireties.

As used herein, the terms, "administration," "administering" and variants thereof refers to introducing a composition or agent (e.g., a therapeutic nucleic acid or an immunosuppressant as described herein) into a subject and includes concurrent and sequential introduction of one or more compositions or agents. "Administration" can refer, e.g., to therapeutic, pharmacokinetic, diagnostic, research, placebo, and experimental methods. "Administration" also encompasses in vitro and ex vivo treatments. The introduction of a composition or agent into a subject is by any suitable route, including orally, pulmonarily, intranasally, parenterally (intravenously, intramuscularly, intraperitoneally, or subcutaneously), rectally, intralymphatically, intratumorally, or topically. The introduction of a composition or agent into a subject is by electroporation. Administration includes self-administration and the administration by another. Administration can be carried out by any suitable route. A suitable route of administration allows the composition or the agent to perform its intended function. For example, if a suitable route is intravenous, the composition is administered by introducing the composition or agent into a vein of the subject.

As used herein, the phrases "nucleic acid therapeutic", "therapeutic nucleic acid" and "TNA" are used interchangeably and refer to any modality of therapeutic using nucleic acids as an active component of therapeutic agent to treat a disease or disorder. As used herein, these phrases refer to RNA-based therapeutics and DNA-based therapeutics. Non-limiting examples of RNA-based therapeutics include mRNA, antisense RNA and oligonucleotides, ribozymes, aptamers, interfering RNAs (RNAi), Dicer-substrate dsRNA, small hairpin RNA (shRNA), asymmetrical interfering RNA (aiRNA), microRNA (miRNA). Non-limiting examples of DNA-based therapeutics include minicircle DNA, minigene, viral DNA (e.g., Lentiviral or AAV genome) or non-viral synthetic DNA vectors, closed-ended linear duplex DNA (ceDNA/CELiD), plasmids, bacmids, doggybone (dbDNA™) DNA vectors, minimalistic immunological-defined gene expression (MIDGE)-vector, nonviral ministring DNA vector (linear-covalently closed DNA vector), or dumbbell-shaped DNA minimal vector ("dumbbell DNA").

As used herein, an "effective amount" or "therapeutically effective amount" of a therapeutic agent, such as a FVIII therapeutic protein or fragment thereof, is an amount sufficient to produce the desired effect, e.g., treatment or prevention of hemophilia A. Suitable assays for measuring expression of a target gene or target sequence include, e.g., examination of protein or RNA levels using techniques known to those of skill in the art such as dot blots, northern blots, in situ hybridization, ELISA, immunoprecipitation, enzyme function, as well as phenotypic assays known to those of skill in the art. However, dosage levels are based on a variety of factors, including the type of injury, the age, weight, sex, medical condition of the patient, the severity of the condition, the route of administration, and the particular active agent employed. Thus, the dosage regimen may vary widely, but can be determined routinely by a physician using standard methods. Additionally, the terms "therapeutic amount", "therapeutically effective amounts" and "pharmaceutically effective amounts" include prophylactic or preventative amounts of the compositions of the described invention. In prophylactic or preventative applications of the described invention, pharmaceutical compositions or medicaments are administered to a patient susceptible to, or otherwise at risk of, a disease, disorder or condition in an amount sufficient to eliminate or reduce the risk, lessen the severity, or delay the onset of the disease, disorder or condition, including biochemical, histologic and/or behavioral symptoms of the disease, disorder or condition, its complications, and intermediate pathological phenotypes presenting during development of the disease, disorder or condition. It is generally preferred that a maximum dose be used, that is, the highest safe dose according to some medical judgment. According to some embodiments, the disease, disorder or condition is hemophilia A. The terms "dose" and "dosage" are used interchangeably herein.

As used herein the term "therapeutic effect" refers to a consequence of treatment, the results of which are judged to be desirable and beneficial. A therapeutic effect can include, directly or indirectly, the arrest, reduction, or elimination of a disease manifestation. A therapeutic effect can also include, directly or indirectly, the arrest reduction or elimination of the progression of a disease manifestation.

For any therapeutic agent described herein therapeutically effective amount may be initially determined from preliminary in vitro studies and/or animal models. A therapeutically effective dose may also be determined from human data. The applied dose may be adjusted based on the relative bioavailability and potency of the administered compound. Adjusting the dose to achieve maximal efficacy based on the methods described above and other well-known methods is within the capabilities of the ordinarily skilled artisan. General principles for determining therapeutic effectiveness, which may be found in Chapter 1 of Goodman and Gilman's The Pharmacological Basis of Therapeutics, $10^{th}$ Edition, McGraw-Hill (New York) (2001), incorporated herein by reference, are summarized below.

Pharmacokinetic principles provide a basis for modifying a dosage regimen to obtain a desired degree of therapeutic efficacy with a minimum of unacceptable adverse effects. In situations where the drug's plasma concentration can be measured and related to therapeutic window, additional guidance for dosage modification can be obtained.

As used herein, the terms "heterologous nucleotide sequence" and "transgene" are used interchangeably and refer to a nucleic acid of interest (other than a nucleic acid encoding a capsid polypeptide) that is incorporated into and may be delivered and expressed by a ceDNA vector as disclosed herein.

As used herein, the terms "expression cassette" and "transcription cassette" are used interchangeably and refer to a linear stretch of nucleic acids that includes a transgene that is operably linked to one or more promoters or other regulatory sequences sufficient to direct transcription of the transgene, but which does not comprise capsid-encoding sequences, other vector sequences or inverted terminal repeat regions. An expression cassette may additionally comprise one or more cis-acting sequences (e.g., promoters, enhancers, or repressors), one or more introns, and one or more post-transcriptional regulatory elements.

The terms "polynucleotide" and "nucleic acid," used interchangeably herein, refer to a polymeric form of nucleotides of any length, either ribonucleotides or deoxyribonucleotides. Thus, this term includes single, double, or multi-stranded DNA or RNA, genomic DNA, cDNA, DNA-RNA hybrids, or a polymer including purine and pyrimidine bases or other natural, chemically or biochemically modified, non-natural, or derivatized nucleotide bases. "Oligonucleotide" generally refers to polynucleotides of between about 5 and about 100 nucleotides of single- or double-stranded DNA. However, for the purposes of this disclosure, there is no upper limit to the length of an oligonucleotide. Oligonucleotides are also known as "oligomers" or "oligos" and may be isolated from genes, or chemically synthesized by methods known in the art. The terms "polynucleotide" and "nucleic acid" should be understood to include, as applicable to the embodiments being described, single-stranded (such as sense or antisense) and double-stranded polynucleotides. DNA may be in the form of, e.g., antisense molecules, plasmid DNA, DNA-DNA duplexes, pre-condensed DNA, PCR products, vectors (P1, PAC, BAC, YAC, artificial chromosomes), expression cassettes, chimeric sequences, chromosomal DNA, or derivatives and combinations of these groups. DNA may be in the form of minicircle, plasmid, bacmid, minigene, ministring DNA (linear covalently closed DNA vector), closed-ended linear duplex DNA (CELiD or ceDNA), doggybone (dbDNA™) DNA, dumbbell shaped DNA, minimalistic immunological-defined gene expression (MIDGE)-vector, viral vector or nonviral vectors. RNA may be in the form of small interfering RNA (siRNA), Dicer-substrate dsRNA, small hairpin RNA (shRNA), asymmetrical interfering RNA (aiRNA), microRNA (miRNA), mRNA, rRNA, tRNA, viral RNA (vRNA), and combinations thereof. Nucleic acids include nucleic acids containing known nucleotide analogs or modified backbone residues or linkages, which are synthetic, naturally occurring, and non-naturally occurring, and which have similar binding properties as the reference nucleic acid. Examples of such analogs and/or modified residues include, without limitation, phosphorothioates, phosphorodiamidate morpholino oligomer (morpholino), phosphoramidates, methyl phosphonates, chiral-methyl phosphonates, 2'-O-methyl ribonucleotides, locked nucleic acid (LNA™), and peptide nucleic acids (PNAs). Unless specifically limited, the term encompasses nucleic acids containing known analogues of natural nucleotides that have similar binding properties as the reference nucleic acid. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated.

"Nucleotides" contain a sugar deoxyribose (DNA) or ribose (RNA), a base, and a phosphate group. Nucleotides are linked together through the phosphate groups.

"Bases" include purines and pyrimidines, which further include natural compounds adenine, thymine, guanine, cytosine, uracil, inosine, and natural analogs, and synthetic derivatives of purines and pyrimidines, which include, but are not limited to, modifications which place new reactive groups such as, but not limited to, amines, alcohols, thiols, carboxylates, and alkylhalides.

As used herein, the term "interfering RNA" or "RNAi" or "interfering RNA sequence" includes single-stranded RNA (e.g., mature miRNA, ssRNAi oligonucleotides, ssDNAi oligonucleotides), double-stranded RNA (i.e., duplex RNA such as siRNA, Dicer-substrate dsRNA, shRNA, aiRNA, or pre-miRNA), a DNA-RNA hybrid (see, e.g., PCT Publication No. WO 2004/078941), or a DNA-DNA hybrid (see, e.g., PCT Publication No. WO 2004/104199) that is capable of reducing or inhibiting the expression of a target gene or sequence (e.g., by mediating the degradation or inhibiting the translation of mRNAs which are complementary to the interfering RNA sequence) when the interfering RNA is in the same cell as the target gene or sequence. Interfering RNA thus refers to the single-stranded RNA that is complementary to a target mRNA sequence or to the double-stranded RNA formed by two complementary strands or by a single, self-complementary strand. Interfering RNA may have substantial or complete identity to the target gene or sequence, or may comprise a region of mismatch (i.e., a mismatch motif). The sequence of the interfering RNA can correspond to the full-length target gene, or a subsequence thereof. Preferably, the interfering RNA molecules are chemically synthesized. The disclosures of each of the above patent documents are herein incorporated by reference in their entirety for all purposes.

Interfering RNA includes "small-interfering RNA" or "siRNA," e.g., interfering RNA of about 15-60, 15-50, or 15-40 (duplex) nucleotides in length, more typically about 15-30, 15-25, or 19-25 (duplex) nucleotides in length, and is preferably about 20-24, 21-22, or 21-23 (duplex) nucleotides in length (e.g., each complementary sequence of the double-stranded siRNA is 15-60, 15-50, 15-40, 15-30, 15-25, or 19-25 nucleotides in length, preferably about 20-24, 21-22, or 21-23 nucleotides in length, and the double-stranded siRNA is about 15-60, 15-50, 15-40, 15-30, 15-25, or 19-25 base pairs in length, preferably about 18-22, 19-20, or 19-21 base pairs in length). siRNA duplexes may comprise 3' overhangs of about 1 to about 4 nucleotides or about 2 to about 3 nucleotides and 5' phosphate termini Examples of siRNA include, without limitation, a double-stranded polynucleotide molecule assembled from two separate stranded molecules, wherein one strand is the sense strand and the other is the complementary antisense strand; a double-stranded polynucleotide molecule assembled from a single stranded molecule, where the sense and antisense regions are linked by a nucleic acid-based or non-nucleic acid-based linker; a double-stranded polynucleotide molecule with a hairpin secondary structure having self-complementary sense and antisense regions; and a circular single-stranded polynucleotide molecule with two or more loop structures and a stem having self-complementary sense and antisense regions, where the circular polynucleotide can be processed in vivo or in vitro to generate an active double-stranded siRNA molecule. As used herein, the term "siRNA" includes RNA-RNA duplexes as well as DNA-RNA hybrids (see, e.g., PCT Publication No. WO 2004/078941).

The term "nucleic acid construct" as used herein refers to a nucleic acid molecule, either single- or double-stranded, which is isolated from a naturally occurring gene or which is modified to contain segments of nucleic acids in a manner that would not otherwise exist in nature or which is synthetic. The term nucleic acid construct is synonymous with the term "expression cassette" when the nucleic acid construct contains the control sequences required for expression of a coding sequence of the present disclosure. An "expression cassette" includes a DNA coding sequence operably linked to a promoter.

By "hybridizable" or "complementary" or "substantially complementary" it is meant that a nucleic acid (e.g., RNA) includes a sequence of nucleotides that enables it to non-covalently bind, i.e. form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. As is known in the art, standard Watson-Crick base-pairing includes: adenine (A) pairing with thymidine (T), adenine (A) pairing with uracil (U), and guanine (G) pairing with cytosine (C). In addition, it is also known in the art that for hybridization between two RNA molecules (e.g., dsRNA), guanine (G) base pairs with uracil (U). For example, G/U base-pairing is partially responsible for the degeneracy (i.e., redundancy) of the genetic code in the context of tRNA anti-codon base-pairing with codons in mRNA. In the context of this disclosure, a guanine (G) of a protein-binding segment (dsRNA duplex) of a subject DNA-targeting RNA molecule is considered complementary to an uracil (U), and vice versa. As such, when a G/U base-pair can be made at a given nucleotide position a protein-binding segment (dsRNA duplex) of a subject DNA-targeting RNA molecule, the position is not considered to be non-complementary, but is instead considered to be complementary.

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones.

A DNA sequence that "encodes" a particular FVIII protein is a DNA nucleic acid sequence that is transcribed into the particular RNA and/or protein. A DNA polynucleotide may encode an RNA (mRNA) that is translated into protein, or a DNA polynucleotide may encode an RNA that is not translated into protein (e.g., tRNA, rRNA, or a DNA-targeting RNA; also called "non-coding" RNA or ncRNA").

As used herein, the term "fusion protein" as used herein refers to a polypeptide which comprises protein domains from at least two different proteins. For example, a fusion protein may comprise (i) FVIII or fragment thereof and (ii) at least one non-GOI protein. Fusion proteins encompassed herein include, but are not limited to, an antibody, or Fc or antigen-binding fragment of an antibody fused to a FVIII protein, e.g., an extracellular domain of a receptor, ligand, enzyme or peptide. The FVIII protein or fragment thereof that is part of a fusion protein can be a monospecific antibody or a bispecific or multispecific antibody.

As used herein, the term "genomic safe harbor gene" or "safe harbor gene" refers to a gene or loci that a nucleic acid sequence can be inserted such that the sequence can integrate and function in a predictable manner (e.g., express a protein of interest) without significant negative consequences to endogenous gene activity, or the promotion of cancer. In some embodiments, a safe harbor gene is also a loci or gene where an inserted nucleic acid sequence can be expressed efficiently and at higher levels than a non-safe harbor site.

As used herein, the term "gene delivery" means a process by which foreign DNA is transferred to host cells for applications of gene therapy.

As used herein, the term "terminal repeat" or "TR" includes any viral terminal repeat or synthetic sequence that comprises at least one minimal required origin of replication and a region comprising a palindrome hairpin structure. A Rep-binding sequence ("RBS") (also referred to as RBE (Rep-binding element)) and a terminal resolution site ("TRS") together constitute a "minimal required origin of replication" and thus the TR comprises at least one RBS and at least one TRS. TRs that are the inverse complement of one another within a given stretch of polynucleotide sequence are typically each referred to as an "inverted terminal repeat" or "ITR". In the context of a virus, ITRs mediate replication, virus packaging, integration and provirus rescue. As was unexpectedly found in the invention herein, TRs that are not inverse complements across their full length can still perform the traditional functions of ITRs, and thus the term ITR is used herein to refer to a TR in a ceDNA genome or ceDNA vector that is capable of mediating replication of ceDNA vector. It will be understood by one of ordinary skill in the art that in complex ceDNA vector configurations more than two ITRs or asymmetric ITR pairs may be present. The ITR can be an AAV ITR or a non-AAV ITR, or can be derived from an AAV ITR or a non-AAV ITR. For example, the ITR can be derived from the family Parvoviridae, which encompasses parvoviruses and dependoviruses (e.g., canine parvovirus, bovine parvovirus, mouse parvovirus, porcine parvovirus, human parvovirus B-19), or the SV40 hairpin that serves as the origin of SV40 replication can be used as an ITR, which can further be modified by truncation, substitution, deletion, insertion and/or addition. Parvoviridae family viruses consist of two subfamilies Parvoviridae, which infect vertebrates, and Densovirinae, which infect invertebrates. Dependoparvoviruses include the viral family of the adeno-associated viruses (AAV) which are capable of replication in vertebrate hosts including, but not limited to, human, primate, bovine, canine, equine and ovine species. For convenience herein, an ITR located 5' to (upstream of) an expression cassette in a ceDNA vector is referred to as a “5' ITR” or a “left ITR”, and an ITR located 3' to (downstream of) an expression cassette in a ceDNA vector is referred to as a “3' ITR” or a “right ITR”.

A “wild-type ITR” or “WT-ITR” refers to the sequence of a naturally occurring ITR sequence in an AAV or other dependovirus that retains, e.g., Rep binding activity and Rep nicking ability. The nucleotide sequence of a WT-ITR from any AAV serotype may slightly vary from the canonical naturally occurring sequence due to degeneracy of the genetic code or drift, and therefore WT-ITR sequences encompassed for use herein include WT-ITR sequences as result of naturally occurring changes taking place during the production process (e.g., a replication error).

As used herein, the term “substantially symmetrical WT-ITRs” or a “substantially symmetrical WT-ITR pair” refers to a pair of WT-ITRs within a single ceDNA genome or ceDNA vector that are both wild type ITRs that have an inverse complement sequence across their entire length. For example, an ITR can be considered to be a wild-type sequence, even if it has one or more nucleotides that deviate from the canonical naturally occurring sequence, so long as the changes do not affect the properties and overall three-dimensional structure of the sequence. In some aspects, the deviating nucleotides represent conservative sequence changes. As one non-limiting example, a sequence that has at least 95%, 96%, 97%, 98%, or 99% sequence identity to the canonical sequence (as measured, e.g., using BLAST at default settings), and also has a symmetrical three-dimensional spatial organization to the other WT-ITR such that their 3D structures are the same shape in geometrical space. The substantially symmetrical WT-ITR has the same A, C-C' and B-B' loops in 3D space. A substantially symmetrical WT-ITR can be functionally confirmed as WT by determining that it has an operable Rep binding site (RBE or RBE') and terminal resolution site (TRS) that pairs with the appropriate Rep protein. One can optionally test other functions, including transgene expression under permissive conditions.

As used herein, the phrases of “modified ITR” or “mod-ITR” or “mutant ITR” are used interchangeably herein and refer to an ITR that has a mutation in at least one or more nucleotides as compared to the WT-ITR from the same serotype. The mutation can result in a change in one or more of A, C, C', B, B' regions in the ITR, and can result in a change in the three-dimensional spatial organization (i.e. its 3D structure in geometric space) as compared to the 3D spatial organization of a WT-ITR of the same serotype.

As used herein, the term “asymmetric ITRs” also referred to as “asymmetric ITR pairs” refers to a pair of ITRs within a single ceDNA genome or ceDNA vector that are not inverse complements across their full length. As one non-limiting example, an asymmetric ITR pair does not have a symmetrical three-dimensional spatial organization to their cognate ITR such that their 3D structures are different shapes in geometrical space. Stated differently, an asymmetrical ITR pair have the different overall geometric structure, i.e., they have different organization of their A, C-C' and B-B' loops in 3D space (e.g., one ITR may have a short C-C' arm and/or short B-B' arm as compared to the cognate ITR). The difference in sequence between the two ITRs may be due to one or more nucleotide addition, deletion, truncation, or point mutation. In one embodiment, one ITR of the asymmetric ITR pair may be a wild-type AAV ITR sequence and the other ITR a modified ITR as defined herein (e.g., a non-wild-type or synthetic ITR sequence). In another embodiment, neither ITRs of the asymmetric ITR pair is a wild-type AAV sequence and the two ITRs are modified ITRs that have different shapes in geometrical space (i.e., a different overall geometric structure). In some embodiments, one mod-ITRs of an asymmetric ITR pair can have a short C-C' arm and the other ITR can have a different modification (e.g., a single arm, or a short B-B' arm etc.) such that they have different three-dimensional spatial organization as compared to the cognate asymmetric mod-ITR.

As used herein, the term “symmetric ITRs” refers to a pair of ITRs within a single ceDNA genome or ceDNA vector that are wild-type or mutated (e.g., modified relative to wild-type) dependoviral ITR sequences and are inverse complements across their full length. In one non-limiting example, both ITRs are wild type ITRs sequences from AAV2. In another example, neither ITRs are wild type ITR AAV2 sequences (i.e., they are a modified ITR, also referred to as a mutant ITR), and can have a difference in sequence from the wild type ITR due to nucleotide addition, deletion, substitution, truncation, or point mutation. For convenience herein, an ITR located 5' to (upstream of) an expression cassette in a ceDNA vector is referred to as a “5' ITR” or a “left ITR”, and an ITR located 3' to (downstream of) an expression cassette in a ceDNA vector is referred to as a “3' ITR” or a “right ITR”.

As used herein, the terms “substantially symmetrical modified-ITRs” or a “substantially symmetrical mod-ITR pair” refers to a pair of modified-ITRs within a single ceDNA genome or ceDNA vector that are both that have an inverse complement sequence across their entire length. For example, the a modified ITR can be considered substantially symmetrical, even if it has some nucleotide sequences that deviate from the inverse complement sequence so long as the changes do not affect the properties and overall shape. As one non-limiting example, a sequence that has at least 85%, 90%, 95%, 96%, 97%, 98%, or 99% sequence identity to the canonical sequence (as measured using BLAST at default settings), and also has a symmetrical three-dimensional spatial organization to their cognate modified ITR such that their 3D structures are the same shape in geometrical space. Stated differently, a substantially symmetrical modified-ITR pair have the same A, C-C' and B-B' loops organized in 3D space. In some embodiments, the ITRs from a mod-ITR pair may have different reverse complement nucleotide sequences but still have the same symmetrical three-dimensional spatial organization—that is both ITRs have mutations that result in the same overall 3D shape. For example, one ITR (e.g., 5' ITR) in a mod-ITR pair can be from one serotype, and the other ITR (e.g., 3' ITR) can be from a different serotype, however, both can have the same corresponding mutation (e.g., if the 5'ITR has a deletion in the C region, the cognate modified 3'ITR from a different serotype has a deletion at the corresponding position in the C' region), such that the modified ITR pair has the same symmetrical three-dimensional spatial organization. In such embodiments, each ITR in a modified ITR pair can be from different serotypes (e.g. AAV1, 2, 3, 4, 5, 6, 7, 8, 9, 10, 11, and 12) such as the combination of AAV2 and AAV6, with the modification in one ITR reflected in the corresponding position in the cognate ITR from a different serotype. In one embodiment, a substantially symmetrical modified ITR pair refers to a pair of modified ITRs (mod-ITRs) so long as the difference in nucleotide sequences between the ITRs does not affect the properties or overall shape and they have substantially the same shape in 3D space. As a non-limiting example, a mod-ITR that has at least 95%, 96%, 97%, 98% or 99% sequence identity to the canonical mod-ITR as determined by standard means well known in the art such as BLAST (Basic Local Alignment Search Tool), or BLASTN at default settings, and also has a symmetrical three-dimensional spatial organization such that their 3D structure is the same shape in geometric space. A substantially symmetrical mod-ITR pair has the same A, C-C' and B-B' loops in 3D space, e.g., if a modified ITR in a substantially symmetrical mod-ITR pair has a deletion of a C-C' arm, then the cognate mod-ITR has the corresponding deletion of the C-C' loop and also has a similar 3D structure of the remaining A and B-B' loops in the same shape in geometric space of its cognate mod-ITR.

The term "flanking" refers to a relative position of one nucleic acid sequence with respect to another nucleic acid sequence. Generally, in the sequence ABC, B is flanked by A and C. The same is true for the arrangement A×B×C. Thus, a flanking sequence precedes or follows a flanked sequence but need not be contiguous with, or immediately adjacent to the flanked sequence. In one embodiment, the term flanking refers to terminal repeats at each end of the linear duplex ceDNA vector.

As used herein, the terms "treat," "treating," and/or "treatment" include abrogating, substantially inhibiting, slowing or reversing the progression of a condition, substantially ameliorating clinical symptoms of a condition, or substantially preventing the appearance of clinical symptoms of a condition, obtaining beneficial or desired clinical results. According to some embodiments, the condition is hemophilia A. Treating further refers to accomplishing one or more of the following: (a) reducing the severity of the disorder; (b) limiting development of symptoms characteristic of the disorder(s) being treated; (c) limiting worsening of symptoms characteristic of the disorder(s) being treated; (d) limiting recurrence of the disorder(s) in patients that have previously had the disorder(s); and (e) limiting recurrence of symptoms in patients that were previously asymptomatic for the disorder(s). Beneficial or desired clinical results, such as pharmacologic and/or physiologic effects include, but are not limited to, preventing the disease, disorder or condition from occurring in a subject that may be predisposed to the disease, disorder or condition but does not yet experience or exhibit symptoms of the disease (prophylactic treatment), alleviation of symptoms of the disease, disorder or condition, diminishment of extent of the disease, disorder or condition, stabilization (i.e., not worsening) of the disease, disorder or condition, preventing spread of the disease, disorder or condition, delaying or slowing of the disease, disorder or condition progression, amelioration or palliation of the disease, disorder or condition, and combinations thereof, as well as prolonging survival as compared to expected survival if not receiving treatment.

As used herein, the term "increase," "enhance," "raise" (and like terms) generally refers to the act of increasing, either directly or indirectly, a concentration, level, function, activity, or behavior relative to the natural, expected, or average, or relative to a control condition.

As used herein, the term "minimize", "reduce", "decrease," and/or "inhibit" (and like terms) generally refers to the act of reducing, either directly or indirectly, a concentration, level, function, activity, or behavior relative to the natural, expected, or average, or relative to a control condition.

As used herein, the term "ceDNA genome" refers to an expression cassette that further incorporates at least one inverted terminal repeat region. A ceDNA genome may further comprise one or more spacer regions. In some embodiments the ceDNA genome is incorporated as an intermolecular duplex polynucleotide of DNA into a plasmid or viral genome.

As used herein, the term "ceDNA spacer region" refers to an intervening sequence that separates functional elements in the ceDNA vector or ceDNA genome. In some embodiments, ceDNA spacer regions keep two functional elements at a desired distance for optimal functionality. In some embodiments, ceDNA spacer regions provide or add to the genetic stability of the ceDNA genome within e.g., a plasmid or baculovirus. In some embodiments, ceDNA spacer regions facilitate ready genetic manipulation of the ceDNA genome by providing a convenient location for cloning sites and the like. For example, in certain aspects, an oligonucleotide "polylinker" containing several restriction endonuclease sites, or a non-open reading frame sequence designed to have no known protein (e.g., transcription factor) binding sites can be positioned in the ceDNA genome to separate the cis—acting factors, e.g., inserting a 6 mer, 12 mer, 18 mer, 24 mer, 48 mer, 86 mer, 176 mer, etc. between the terminal resolution site and the upstream transcriptional regulatory element. Similarly, the spacer may be incorporated between the polyadenylation signal sequence and the 3'-terminal resolution site.

As used herein, the terms "Rep binding site, "Rep binding element, "RBE" and "RBS" are used interchangeably and refer to a binding site for Rep protein (e.g., AAV Rep 78 or AAV Rep 68) which upon binding by a Rep protein permits the Rep protein to perform its site-specific endonuclease activity on the sequence incorporating the RBS. An RBS sequence and its inverse complement together form a single RBS. RBS sequences are known in the art, and include, for example, 5'-GCGCGCTCGCTCGCTC-3' (SEQ ID NO: 60), an RBS sequence identified in AAV2. Any known RBS sequence may be used in the embodiments of the invention, including other known AAV RBS sequences and other naturally known or synthetic RBS sequences. Without being bound by theory it is thought that he nuclease domain of a Rep protein binds to the duplex nucleotide sequence GCTC, and thus the two known AAV Rep proteins bind directly to and stably assemble on the duplex oligonucleotide, 5'-(GCGC)(GCTC)(GCTC)(GCTC)-3' (SEQ ID NO: 60). In addition, soluble aggregated conformers (i.e., undefined number of inter-associated Rep proteins) dissociate and bind to oligonucleotides that contain Rep binding sites. Each Rep protein interacts with both the nitrogenous bases and phosphodiester backbone on each strand. The interactions with the nitrogenous bases provide sequence specificity whereas the interactions with the phosphodiester backbone are non- or less-sequence specific and stabilize the protein-DNA complex.

As used herein, the terms "terminal resolution site" and "TRS" are used interchangeably herein and refer to a region at which Rep forms a tyrosine-phosphodiester bond with the 5' thymidine generating a 3' OH that serves as a substrate for DNA extension via a cellular DNA polymerase, e.g., DNA pol delta or DNA pol epsilon. Alternatively, the Rep-thymidine complex may participate in a coordinated ligation reaction. In some embodiments, a TRS minimally encompasses a non-base-paired thymidine. In some embodiments, the nicking efficiency of the TRS can be controlled at least in part by its distance within the same molecule from the RBS. When the acceptor substrate is the complementary ITR, then the resulting product is an intramolecular duplex. TRS sequences are known in the art, and include, for example, 5'-GGTTGA-3' (SEQ ID NO: 61), the hexanucleotide sequence identified in AAV2. Any known TRS sequence may be used in the embodiments of the invention, including other known AAV TRS sequences and other naturally known or synthetic TRS sequences such as AGTT (SEQ ID NO: 62), GGTTGG (SEQ ID NO: 63), AGTTGG (SEQ ID NO: 64), AGTTGA (SEQ ID NO: 65), and other motifs such as RRTTRR (SEQ ID NO: 66).

As used herein, the term "ceDNA-plasmid" refers to a plasmid that comprises a ceDNA genome as an intermolecular duplex.

As used herein, the term "ceDNA-bacmid" refers to an infectious baculovirus genome comprising a ceDNA genome as an intermolecular duplex that is capable of propagating in *E. coli* as a plasmid, and so can operate as a shuttle vector for baculovirus.

As used herein, the term "ceDNA-baculovirus" refers to a baculovirus that comprises a ceDNA genome as an intermolecular duplex within the baculovirus genome.

As used herein, the terms "ceDNA-baculovirus infected insect cell" and "ceDNA-BIIC" are used interchangeably, and refer to an invertebrate host cell (including, but not limited to an insect cell (e.g., an Sf9 cell)) infected with a ceDNA-baculovirus.

As used herein, the term "ceDNA" refers to capsid-free closed-ended linear double stranded (ds) duplex DNA for non-viral gene transfer, synthetic or otherwise. Detailed description of ceDNA is described in International application of PCT/US2017/020828, filed Mar. 3, 2017, the entire contents of which are expressly incorporated herein by reference. Certain methods for the production of ceDNA comprising various inverted terminal repeat (ITR) sequences and configurations using cell-based methods are described in Example 1 of International applications PCT/US18/49996, filed Sep. 7, 2018, and PCT/US2018/064242, filed Dec. 6, 2018 each of which is incorporated herein in its entirety by reference. Certain methods for the production of synthetic ceDNA vectors comprising various ITR sequences and configurations are described, e.g., in International application PCT/US2019/14122, filed Jan. 18, 2019, the entire content of which is incorporated herein by reference.

As used herein, the term "closed-ended DNA vector" refers to a capsid-free DNA vector with at least one covalently closed end and where at least part of the vector has an intramolecular duplex structure.

As used herein, the terms "ceDNA vector" and "ceDNA" are used interchangeably and refer to a closed-ended DNA vector comprising at least one terminal palindrome. In some embodiments, the ceDNA comprises two covalently-closed ends.

As used herein, the term "neDNA" or "nicked ceDNA" refers to a closed-ended DNA having a nick or a gap of 1-100 base pairs in a stem region or spacer region 5' upstream of an open reading frame (e.g., a promoter and transgene to be expressed).

As used herein, the terms "gap" and "nick" are used interchangeably and refer to a discontinued portion of synthetic DNA vector of the present invention, creating a stretch of single stranded DNA portion in otherwise double stranded ceDNA. The gap can be 1 base-pair to 100 base-pair long in length in one strand of a duplex DNA. Typical gaps, designed and created by the methods described herein and synthetic vectors generated by the methods can be, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or 60 bp long in length. Exemplified gaps in the present disclosure can be 1 bp to 10 bp long, 1 to 20 bp long, 1 to 30 bp long in length.

As defined herein, "reporters" refer to proteins that can be used to provide detectable read-outs. Reporters generally produce a measurable signal such as fluorescence, color, or luminescence. Reporter protein coding sequences encode proteins whose presence in the cell or organism is readily observed. For example, fluorescent proteins cause a cell to fluoresce when excited with light of a particular wavelength, luciferases cause a cell to catalyze a reaction that produces light, and enzymes such as β-galactosidase convert a substrate to a colored product. Exemplary reporter polypeptides useful for experimental or diagnostic purposes include, but are not limited to β-lactamase, β-galactosidase (LacZ), alkaline phosphatase (AP), thymidine kinase (TK), green fluorescent protein (GFP) and other fluorescent proteins, chloramphenicol acetyltransferase (CAT), luciferase, and others well known in the art.

As used herein, the terms "sense" and "antisense" refer to the orientation of the structural element on the polynucleotide. The sense and antisense versions of an element are the reverse complement of each other.

As used herein, the term "synthetic AAV vector" and "synthetic production of AAV vector" refers to an AAV vector and synthetic production methods thereof in an entirely cell-free environment.

As used herein, "reporters" refer to proteins that can be used to provide detectable read-outs. Reporters generally produce a measurable signal such as fluorescence, color, or luminescence. Reporter protein coding sequences encode proteins whose presence in the cell or organism is readily observed. For example, fluorescent proteins cause a cell to fluoresce when excited with light of a particular wavelength, luciferases cause a cell to catalyze a reaction that produces light, and enzymes such as β-galactosidase convert a substrate to a colored product. Exemplary reporter polypeptides useful for experimental or diagnostic purposes include, but are not limited to β-lactamase, β-galactosidase (LacZ), alkaline phosphatase (AP), thymidine kinase (TK), green fluorescent protein (GFP) and other fluorescent proteins, chloramphenicol acetyltransferase (CAT), luciferase, and others well known in the art.

As used herein, the term "effector protein" refers to a polypeptide that provides a detectable read-out, either as, for example, a reporter polypeptide, or more appropriately, as a polypeptide that kills a cell, e.g., a toxin, or an agent that renders a cell susceptible to killing with a chosen agent or lack thereof. Effector proteins include any protein or peptide that directly targets or damages the host cell's DNA and/or RNA. For example, effector proteins can include, but are not limited to, a restriction endonuclease that targets a host cell DNA sequence (whether genomic or on an extrachromosomal element), a protease that degrades a polypeptide target necessary for cell survival, a DNA gyrase inhibitor, and a ribonuclease-type toxin. In some embodiments, the expression of an effector protein controlled by a synthetic biological circuit as described herein can participate as a factor in another synthetic biological circuit to thereby expand the range and complexity of a biological circuit system's responsiveness.

Transcriptional regulators refer to transcriptional activators and repressors that either activate or repress transcription of a gene of interest, such as FVIII. Promoters are regions of nucleic acid that initiate transcription of a particular gene Transcriptional activators typically bind nearby to transcriptional promoters and recruit RNA polymerase to directly initiate transcription. Repressors bind to transcriptional promoters and sterically hinder transcriptional initiation by RNA polymerase. Other transcriptional regulators may serve as either an activator or a repressor depending on where they bind and cellular and environmental conditions. Non-limiting examples of transcriptional regulator classes include, but are not limited to homeodomain proteins, zinc-finger proteins, winged-helix (forkhead) proteins, and leucine-zipper proteins.

As used herein, a "repressor protein" or "inducer protein" is a protein that binds to a regulatory sequence element and represses or activates, respectively, the transcription of sequences operatively linked to the regulatory sequence element. Preferred repressor and inducer proteins as described herein are sensitive to the presence or absence of at least one input agent or environmental input. Preferred proteins as described herein are modular in form, comprising, for example, separable DNA-binding and input agent-binding or responsive elements or domains.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutically active substances is well known in the art. Supplementary active ingredients can also be incorporated into the compositions. The phrase "pharmaceutically-acceptable" refers to molecular entities and compositions that do not produce a toxic, an allergic, or similar untoward reaction when administered to a host.

As used herein, an "input agent responsive domain" is a domain of a transcription factor that binds to or otherwise responds to a condition or input agent in a manner that renders a linked DNA binding fusion domain responsive to the presence of that condition or input. In one embodiment, the presence of the condition or input results in a conformational change in the input agent responsive domain, or in a protein to which it is fused, that modifies the transcription-modulating activity of the transcription factor.

The term "in vivo" refers to assays or processes that occur in or within an organism, such as a multicellular animal. In some of the aspects described herein, a method or use can be said to occur "in vivo" when a unicellular organism, such as a bacterium, is used. The term "ex vivo" refers to methods and uses that are performed using a living cell with an intact membrane that is outside of the body of a multicellular animal or plant, e.g., explants, cultured cells, including primary cells and cell lines, transformed cell lines, and extracted tissue or cells, including blood cells, among others. The term "in vitro" refers to assays and methods that do not require the presence of a cell with an intact membrane, such as cellular extracts, and can refer to the introducing of a programmable synthetic biological circuit in a non-cellular system, such as a medium not comprising cells or cellular systems, such as cellular extracts.

The term "promoter," as used herein, refers to any nucleic acid sequence that regulates the expression of another nucleic acid sequence by driving transcription of the nucleic acid sequence, which can be a heterologous target gene encoding a protein or an RNA. Promoters can be constitutive, inducible, repressible, tissue-specific, or any combination thereof. A promoter is a control region of a nucleic acid sequence at which initiation and rate of transcription of the remainder of a nucleic acid sequence are controlled. A promoter can also contain genetic elements at which regulatory proteins and molecules can bind, such as RNA polymerase and other transcription factors. In some embodiments of the aspects described herein, a promoter can drive the expression of a transcription factor that regulates the expression of the promoter itself. Within the promoter sequence will be found a transcription initiation site, as well as protein binding domains responsible for the binding of RNA polymerase. Eukaryotic promoters will often, but not always, contain "TATA" boxes and "CAT" boxes. Various promoters, including inducible promoters, may be used to drive the expression of transgenes in the ceDNA vectors disclosed herein. A promoter sequence may be bounded at its 3' terminus by the transcription initiation site and extends upstream (5' direction) to include the minimum number of bases or elements necessary to initiate transcription at levels detectable above background.

The term "enhancer" as used herein refers to a cis-acting regulatory sequence (e.g., 50-1,500 base pairs) that binds one or more proteins (e.g., activator proteins, or transcription factor) to increase transcriptional activation of a nucleic acid sequence. Enhancers can be positioned up to 1,000,000 base pars upstream of the gene start site or downstream of the gene start site that they regulate. An enhancer can be positioned within an intronic region, or in the exonic region of an unrelated gene.

A promoter can be said to drive expression or drive transcription of the nucleic acid sequence that it regulates. The phrases "operably linked," "operatively positioned," "operatively linked," "under control," and "under transcriptional control" indicate that a promoter is in a correct functional location and/or orientation in relation to a nucleic acid sequence it regulates to control transcriptional initiation and/or expression of that sequence. An "inverted promoter," as used herein, refers to a promoter in which the nucleic acid sequence is in the reverse orientation, such that what was the coding strand is now the non-coding strand, and vice versa. Inverted promoter sequences can be used in various embodiments to regulate the state of a switch. In addition, in various embodiments, a promoter can be used in conjunction with an enhancer.

A promoter can be one naturally associated with a gene or sequence, as can be obtained by isolating the 5' non-coding sequences located upstream of the coding segment and/or exon of a given gene or sequence. Such a promoter can be referred to as "endogenous." Similarly, in some embodiments, an enhancer can be one naturally associated with a nucleic acid sequence, located either downstream or upstream of that sequence.

In some embodiments, a coding nucleic acid segment is positioned under the control of a "recombinant promoter" or "heterologous promoter," both of which refer to a promoter that is not normally associated with the encoded nucleic acid sequence it is operably linked to in its natural environment. A recombinant or heterologous enhancer refers to an enhancer not normally associated with a given nucleic acid sequence in its natural environment. Such promoters or enhancers can include promoters or enhancers of other genes; promoters or enhancers isolated from any other prokaryotic, viral, or eukaryotic cell; and synthetic promoters or enhancers that are not "naturally occurring," i.e., comprise different elements of different transcriptional regulatory regions, and/or mutations that alter expression through methods of genetic engineering that are known in the art. In addition to producing nucleic acid sequences of promoters and enhancers synthetically, promoter sequences can be produced using recombinant cloning and/or nucleic acid amplification technology, including PCR, in connection with the synthetic biological circuits and modules disclosed herein (see, e.g., U.S. Pat. Nos. 4,683,202, 5,928,906, each incorporated herein by reference). Furthermore, it is contemplated that control sequences that direct transcription and/or expression of sequences within non-nuclear organelles such as mitochondria, chloroplasts, and the like, can be employed as well.

As described herein, an "inducible promoter" is one that is characterized by initiating or enhancing transcriptional activity when in the presence of, influenced by, or contacted by an inducer or inducing agent. An "inducer" or "inducing agent," as defined herein, can be endogenous, or a normally exogenous compound or protein that is administered in such a way as to be active in inducing transcriptional activity from the inducible promoter. In some embodiments, the inducer or inducing agent, i.e., a chemical, a compound or a protein, can itself be the result of transcription or expression of a nucleic acid sequence (i.e., an inducer can be an inducer protein expressed by another component or module), which itself can be under the control or an inducible promoter. In some embodiments, an inducible promoter is induced in the absence of certain agents, such as a repressor. Examples of inducible promoters include but are not limited to, tetracycline, metallothionine, ecdysone, mammalian viruses (e.g., the adenovirus late promoter; and the mouse mammary tumor virus long terminal repeat (MMTV-LTR)) and other steroid-responsive promoters, rapamycin responsive promoters and the like.

The terms "DNA regulatory sequences," "control elements," and "regulatory elements," used interchangeably herein, refer to transcriptional and translational control sequences, such as promoters, enhancers, polyadenylation signals, terminators, protein degradation signals, and the like, that provide for and/or regulate transcription of a non-coding sequence (e.g., DNA-targeting RNA) or a coding sequence (e.g., site-directed modifying polypeptide, or Cas9/Csn1 polypeptide) and/or regulate translation of an encoded polypeptide.

"Operably linked" refers to a juxtaposition wherein the components so described are in a relationship permitting them to function in their intended manner. For instance, a promoter is operably linked to a coding sequence if the promoter affects its transcription or expression. An "expression cassette" includes a heterologous DNA sequence that is operably linked to a promoter or other regulatory sequence sufficient to direct transcription of the transgene in the ceDNA vector. Suitable promoters include, for example, tissue specific promoters. Promoters can also be of AAV origin.

The term "subject" as used herein refers to a human or animal, to whom treatment, including prophylactic treatment, with the ceDNA vector according to the present invention, is provided. Usually the animal is a vertebrate such as, but not limited to a primate, rodent, domestic animal or game animal Primates include but are not limited to, chimpanzees, cynomologous monkeys, spider monkeys, and macaques, e.g., Rhesus. Rodents include mice, rats, woodchucks, ferrets, rabbits and hamsters. Domestic and game animals include, but are not limited to, cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. In certain embodiments of the aspects described herein, the subject is a mammal, e.g., a primate or a human A subject can be male or female. Additionally, a subject can be an infant or a child. In some embodiments, the subject can be a neonate or an unborn subject, e.g., the subject is in utero. Preferably, the subject is a mammal. The mammal can be a human, non-human primate, mouse, rat, dog, cat, horse, or cow, but is not limited to these examples. Mammals other than humans can be advantageously used as subjects that represent animal models of diseases and disorders. In addition, the methods and compositions described herein can be used for domesticated animals and/or pets. A human subject can be of any age, gender, race or ethnic group, e.g., Caucasian (white), Asian, African, black, African American, African European, Hispanic, Mideastern, etc. In some embodiments, the subject can be a patient or other subject in a clinical setting. In some embodiments, the subject is already undergoing treatment. In some embodiments, the subject is an embryo, a fetus, neonate, infant, child, adolescent, or adult. In some embodiments, the subject is a human fetus, human neonate, human infant, human child, human adolescent, or human adult. In some embodiments, the subject is an animal embryo, or non-human embryo or non-human primate embryo. In some embodiments, the subject is a human embryo.

As used herein, the term "host cell", includes any cell type that is susceptible to transformation, transfection, transduction, and the like with a nucleic acid construct or ceDNA expression vector of the present disclosure. As non-limiting examples, a host cell can be an isolated primary cell, pluripotent stem cells, $CD34^+$ cells), induced pluripotent stem cells, or any of a number of immortalized cell lines (e.g., HepG2 cells). Alternatively, a host cell can be an in situ or in vivo cell in a tissue, organ or organism.

The term "exogenous" refers to a substance present in a cell other than its native source. The term "exogenous" when used herein can refer to a nucleic acid (e.g., a nucleic acid encoding a polypeptide) or a polypeptide that has been introduced by a process involving the hand of man into a biological system such as a cell or organism in which it is not normally found and one wishes to introduce the nucleic acid or polypeptide into such a cell or organism. Alternatively, "exogenous" can refer to a nucleic acid or a polypeptide that has been introduced by a process involving the hand of man into a biological system such as a cell or organism in which it is found in relatively low amounts and one wishes to increase the amount of the nucleic acid or polypeptide in the cell or organism, e.g., to create ectopic expression or levels. In contrast, the term "endogenous" refers to a substance that is native to the biological system or cell.

The term "sequence identity" refers to the relatedness between two nucleotide sequences. For purposes of the present disclosure, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. The optional parameters used are gap open penalty of 10, gap extension penalty of 0.5, and the EDNAFULL (EMBOSS version of NCBI NUC4.4) substitution matrix. The output of Needle labeled "longest identity" (obtained using the -nobrief option) is used as the percent identity and is calculated as follows: (Identical Deoxyribonucleotides.times.100)/(Length of Alignment-Total Number of Gaps in Alignment). The length of the alignment is preferably at least 10 nucleotides, preferably at least 25 nucleotides more preferred at least 50 nucleotides and most preferred at least 100 nucleotides.

The term "homology" or "homologous" as used herein is defined as the percentage of nucleotide residues that are identical to the nucleotide residues in the corresponding sequence on the target chromosome, after aligning the sequences and introducing gaps, if necessary, to achieve the maximum percent sequence identity. Alignment for purposes of determining percent nucleotide sequence homology can be achieved in various ways that are within the skill in the art, for instance, using publicly available computer software such as BLAST, BLAST-2, ALIGN, ClustalW2 or Megalign (DNASTAR) software. Those skilled in the art can determine appropriate parameters for aligning sequences, including any algorithms needed to achieve maximal alignment over the full length of the sequences being compared. In some embodiments, a nucleic acid sequence (e.g., DNA sequence), for example of a homology arm, is considered "homologous" when the sequence is at least 70%, at least 75%, at least 80%, at least 85%, at least 90%, at least 91%, at least 92%, at least 93%, at least 94%, at least 95%, at least 96%, at least 97%, at least 98%, at least 99%, or more, identical to the corresponding native or unedited nucleic acid sequence (e.g., genomic sequence) of the host cell.

The term "heterologous," as used herein, means a nucleotide or polypeptide sequence that is not found in the native nucleic acid or protein, respectively. A heterologous nucleic acid sequence may be linked to a naturally-occurring nucleic acid sequence (or a variant thereof) (e.g., by genetic engineering) to generate a chimeric nucleotide sequence encoding a chimeric polypeptide. A heterologous nucleic acid sequence may be linked to a variant polypeptide (e.g., by genetic engineering) to generate a nucleotide sequence encoding a fusion variant polypeptide.

A "vector" or "expression vector" is a replicon, such as plasmid, bacmid, phage, virus, virion, or cosmid, to which another DNA segment, i.e. an "insert", may be attached so as to bring about the replication of the attached segment in a cell. A vector can be a nucleic acid construct designed for delivery to a host cell or for transfer between different host cells. As used herein, a vector can be viral or non-viral in origin and/or in final form, however for the purpose of the present disclosure, a "vector" generally refers to a ceDNA vector, as that term is used herein. The term "vector" encompasses any genetic element that is capable of replication when associated with the proper control elements and that can transfer gene sequences to cells. In some embodiments, a vector can be an expression vector or recombinant vector.

As used herein, the term "expression vector" refers to a vector that directs expression of an RNA or polypeptide from sequences linked to transcriptional regulatory sequences on the vector. The sequences expressed will often, but not necessarily, be heterologous to the cell. An expression vector may comprise additional elements, for example, the expression vector may have two replication systems, thus allowing it to be maintained in two organisms, for example in human cells for expression and in a prokaryotic host for cloning and amplification. The term "expression" refers to the cellular processes involved in producing RNA and proteins and as appropriate, secreting proteins, including where applicable, but not limited to, for example, transcription, transcript processing, translation and protein folding, modification and processing. "Expression products" include RNA transcribed from a gene, and polypeptides obtained by translation of mRNA transcribed from a gene. The term "gene" means the nucleic acid sequence which is transcribed (DNA) to RNA in vitro or in vivo when operably linked to appropriate regulatory sequences. The gene may or may not include regions preceding and following the coding region, e.g., 5' untranslated (5'UTR) or "leader" sequences and 3' UTR or "trailer" sequences, as well as intervening sequences (introns) between individual coding segments (exons).

By "recombinant vector" is meant a vector that includes a heterologous nucleic acid sequence, or "transgene" that is capable of expression in vivo. It should be understood that the vectors described herein can, in some embodiments, be combined with other suitable compositions and therapies. In some embodiments, the vector is episomal. The use of a suitable episomal vector provides a means of maintaining the nucleotide of interest in the subject in high copy number extra chromosomal DNA thereby eliminating potential effects of chromosomal integration.

The phrase "genetic disease" as used herein refers to a disease, partially or completely, directly or indirectly, caused by one or more abnormalities in the genome, especially a condition that is present from birth. The abnormality may be a mutation, an insertion or a deletion. The abnormality may affect the coding sequence of the gene or its regulatory sequence. The genetic disease may be, but not limited to DMD, hemophilia, cystic fibrosis, Huntington's chorea, familial hypercholesterolemia (LDL receptor defect), hepatoblastoma, Wilson's disease, congenital hepatic porphyria, inherited disorders of hepatic metabolism, Lesch Nyhan syndrome, sickle cell anemia, thalassemia, xeroderma pigmentosum, Fanconi's anemia, retinitis pigmentosa, ataxia telangiectasia, Bloom's syndrome, retinoblastoma, and Tay-Sachs disease.

An "inhibitory polynucleotide" as used herein refers to a DNA or RNA molecule that reduces or prevents expression (transcription or translation) of a second (target) polynucleotide. Inhibitory polynucleotides include antisense polynucleotides, ribozymes, and external guide sequences. The term "inhibitory polynucleotide" further includes DNA and RNA molecules, e.g., RNAi that encode the actual inhibitory species, such as DNA molecules that encode ribozymes.

As used herein, "gene silencing" or "gene silenced" in reference to an activity of an RNAi molecule, for example a siRNA or miRNA refers to a decrease in the mRNA level in a cell for a target gene.

As used herein, the term "RNAi" refers to any type of interfering RNA, including but not limited to, siRNA, shRNAi, endogenous microRNA and artificial microRNA. For instance, it includes sequences previously identified as siRNA, regardless of the mechanism of down-stream processing of the RNA (i.e. although siRNAs are believed to have a specific method of in vivo processing resulting in the cleavage of mRNA, such sequences can be incorporated into the vectors in the context of the flanking sequences described herein). The term "RNAi" can include both gene silencing RNAi molecules, and also RNAi effector molecules which activate the expression of a gene.

As used herein the term "comprising" or "comprises" is used in reference to compositions, methods, and respective component(s) thereof, that are essential to the method or composition, yet open to the inclusion of unspecified elements, whether essential or not.

As used herein the term "consisting essentially of" refers to those elements required for a given embodiment. The term permits the presence of elements that do not materially affect the basic and novel or functional characteristic(s) of that embodiment. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of additional elements that do not materially affect the basic and novel or functional characteristic(s) of that embodiment of the invention.

As used in this specification and the appended claims, the singular forms "a," "an," and "the" include plural references unless the context clearly dictates otherwise. Thus, for example, references to "the method" includes one or more methods, and/or steps of the type described herein and/or which will become apparent to those persons skilled in the art upon reading this disclosure and so forth. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia and is used herein to indicate a non-limiting example. Thus, the abbreviation "e.g." is synonymous with the term "for example."

Groupings of alternative elements or embodiments of the invention disclosed herein are not to be construed as limitations. Each group member can be referred to and claimed individually or in any combination with other members of the group or other elements found herein. One or more members of a group can be included in, or deleted from, a group for reasons of convenience and/or patentability. When any such inclusion or deletion occurs, the specification is herein deemed to contain the group as modified thus fulfilling the written description of all Markush groups used in the appended claims.

In some embodiments of any of the aspects, the disclosure described herein does not concern a process for cloning human beings, processes for modifying the germ line genetic identity of human beings, uses of human embryos for industrial or commercial purposes or processes for modifying the genetic identity of animals which are likely to cause them suffering without any substantial medical benefit to man or animal, and also animals resulting from such processes.

Other terms are defined herein within the description of the various aspects of the invention.

All patents and other publications; including literature references, issued patents, published patent applications, and co-pending patent applications; cited throughout this application are expressly incorporated herein by reference for the purpose of describing and disclosing, for example, the methodologies described in such publications that might be used in connection with the technology described herein. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

The description of embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. For example, while method steps or functions are presented in a given order, alternative embodiments may perform functions in a different order, or functions may be performed substantially concurrently. The teachings of the disclosure provided herein can be applied to other procedures or methods as appropriate. The various embodiments described herein can be combined to provide further embodiments. Aspects of the disclosure can be modified, if necessary, to employ the compositions, functions and concepts of the above references and application to provide yet further embodiments of the disclosure. Moreover, due to biological functional equivalency considerations, some changes can be made in protein structure without affecting the biological or chemical action in kind or amount. These and other changes can be made to the disclosure in light of the detailed description. All such modifications are intended to be included within the scope of the appended claims.

Specific elements of any of the foregoing embodiments can be combined or substituted for elements in other embodiments. Furthermore, while advantages associated with certain embodiments of the disclosure have been described in the context of these embodiments, other embodiments may also exhibit such advantages, and not all embodiments need necessarily exhibit such advantages to fall within the scope of the disclosure.

The technology described herein is further illustrated by the following examples which in no way should be construed as being further limiting. It should be understood that this invention is not limited to the particular methodology, protocols, and reagents, etc., described herein and as such can vary. The terminology used herein is for the purpose of describing particular embodiments only and is not intended to limit the scope of the present invention, which is defined solely by the claims.

II. Expression of a FVIII Protein from a ceDNA Vector

The technology described herein is directed in general to the expression and/or production of FVIII protein in a cell from a non-viral DNA vector, e.g., a ceDNA vector as described herein. ceDNA vectors for expression of FVIII protein are described herein in the section entitled "ceDNA vectors in general". In particular, ceDNA vectors for expression of FVIII protein comprise a pair of ITRs (e.g., symmetric or asymmetric as described herein) and between the ITR pair, a nucleic acid encoding an FVIII protein, as described herein, operatively linked to a promoter or regulatory sequence. A distinct advantage of ceDNA vectors for expression of FVIII protein over traditional AAV vectors, and even lentiviral vectors, is that there is no size constraint for the heterologous nucleic acid sequences encoding a desired protein. Thus, even a full length 6.8 kb FVIII protein can be expressed from a single ceDNA vector. Thus, the ceDNA vectors described herein can be used to express a therapeutic FVIII protein in a subject in need thereof, e.g., a subject with hemophilia A.

As one will appreciate, the ceDNA vector technologies described herein can be adapted to any level of complexity or can be used in a modular fashion, where expression of different components of a FVIII protein can be controlled in an independent manner. For example, it is specifically contemplated that the ceDNA vector technologies designed herein can be as simple as using a single ceDNA vector to express a single heterologous gene sequence (e.g., a FVIII protein) or can be as complex as using multiple ceDNA vectors, where each vector expresses multiple FVIII proteins or associated co-factors or accessory proteins that are each independently controlled by different promoters. The following embodiments are specifically contemplated herein and can adapted by one of skill in the art as desired.

In one embodiment, a single ceDNA vector can be used to express a single component of an FVIII protein. Alternatively, a single ceDNA vector can be used to express multiple components (e.g., at least 2) of a FVIII protein under the control of a single promoter (e.g., a strong promoter), optionally using an IRES sequence(s) to ensure appropriate expression of each of the components, e.g., co-factors or accessory proteins.

Also contemplated herein, in another embodiment, is a single ceDNA vector comprising at least two inserts (e.g., expressing a heavy chain or light chain), where the expression of each insert is under the control of its own promoter. The promoters can include multiple copies of the same promoter, multiple different promoters, or any combination thereof. As one of skill in the art will appreciate, it is often desirable to express components of a FVIII protein at different expression levels, thus controlling the stoichiometry of the individual components expressed to ensure efficient a FVIII protein folding and combination in the cell.

Additional variations of ceDNA vector technologies can be envisioned by one of skill in the art or can be adapted from protein production methods using conventional vectors.

A. Nucleic Acids

The characterization and development of nucleic acid molecules for potential therapeutic use are provided herein. According to some embodiments, the nucleic acids for therapeutic use encode a FVIII protein. In some embodiments, chemical modification of oligonucleotides for the purpose of altered and improved in vivo properties (delivery, stability, lifetime, folding, target specificity), as well as their biological function and mechanism that directly correlate with therapeutic application, are described where appropriate.

Illustrative therapeutic nucleic acids of the present disclosure that can be immunostimulatory and require use of immunosuppressants disclosed herein can include, but are not limited to, minigenes, plasmids, minicircles, small interfering RNA (siRNA), microRNA (miRNA), antisense oligonucleotides (ASO), ribozymes, closed ended double stranded DNA (e.g., ceDNA, CELiD, linear covalently closed DNA ("ministring"), doggybone (dbDNA™), protelomere closed ended DNA, or dumbbell linear DNA), dicer-substrate dsRNA, small hairpin RNA (shRNA), asymmetrical interfering RNA (aiRNA), microRNA (miRNA), mRNA, tRNA, rRNA, and DNA viral vectors, viral RNA vector, and any combination thereof.

siRNA or miRNA that can downregulate the intracellular levels of specific proteins through a process called RNA interference (RNAi) are also contemplated by the present invention to be nucleic acid therapeutics. After siRNA or miRNA is introduced into the cytoplasm of a host cell, these double-stranded RNA constructs can bind to a protein called RISC. The sense strand of the siRNA or miRNA is removed by the RISC complex. The RISC complex, when combined with the complementary mRNA, cleaves the mRNA and release the cut strands. RNAi is by inducing specific destruction of mRNA that results in downregulation of a corresponding protein.

Antisense oligonucleotides (ASO) and ribozymes that inhibit mRNA translation into protein can be nucleic acid therapeutics. For antisense constructs, these single stranded deoxy nucleic acids have a complementary sequence to the sequence of the target protein mRNA, and Watson—capable of binding to the mRNA by Crick base pairing. This binding prevents translation of a target mRNA, and/or triggers RNaseH degradation of the mRNA transcript. As a result, the antisense oligonucleotide has increased specificity of action (i.e., down-regulation of a specific disease-related protein).

In any of the methods provided herein, the therapeutic nucleic acid can be a therapeutic RNA. The therapeutic RNA can be an inhibitor of mRNA translation, agent of RNA interference (RNAi), catalytically active RNA molecule (ribozyme), transfer RNA (tRNA) or an RNA that binds an mRNA transcript (ASO), protein or other molecular ligand (aptamer). In any of the methods provided herein, the agent of RNAi can be a double-stranded RNA, single-stranded RNA, micro RNA, short interfering RNA, short hairpin RNA, or a triplex-forming oligonucleotide.

According to some embodiments, the therapeutic nucleic acid is a closed ended double stranded DNA, e.g., a ceDNA. According to some embodiments, the expression and/or production of a therapeutic protein in a cell is from a non-viral DNA vector, e.g., a ceDNA vector. A distinct advantage of ceDNA vectors for expression of a therapeutic protein over traditional AAV vectors, and even lentiviral vectors, is that there is no size constraint for the heterologous nucleic acid sequences encoding a desired protein. Thus, even a large therapeutic protein can be expressed from a single ceDNA vector. Thus, ceDNA vectors can be used to express a therapeutic protein in a subject in need thereof.

In general, a ceDNA vector for expression of a therapeutic protein as disclosed herein, comprises in the 5' to 3' direction: a first adeno-associated virus (AAV) inverted terminal repeat (ITR), a nucleotide sequence of interest (for example an expression cassette as described herein) and a second AAV ITR. The ITR sequences selected from any of: (i) at least one WT ITR and at least one modified AAV inverted terminal repeat (mod-ITR) (e.g., asymmetric modified ITRs); (ii) two modified ITRs where the mod-ITR pair have a different three-dimensional spatial organization with respect to each other (e.g., asymmetric modified ITRs), or (iii) symmetrical or substantially symmetrical WT-WT ITR pair, where each WT-ITR has the same three-dimensional spatial organization, or (iv) symmetrical or substantially symmetrical modified ITR pair, where each mod-ITR has the same three-dimensional spatial organization.

In some embodiments, a transgene encoding the FVIII protein can also encode a secretory sequence so that the a FVIII protein is directed to the Golgi Apparatus and Endoplasmic Reticulum whence a FVIII protein will be folded into the correct conformation by chaperone molecules as it passes through the ER and out of the cell. Exemplary secretory sequences include, but are not limited to VH-02 (SEQ ID NO: 88) and VK-A26 (SEQ ID NO: 89) and Igκ signal sequence (SEQ ID NO: 126), as well as a Gluc secretory signal that allows the tagged protein to be secreted out of the cytosol (SEQ ID NO: 188), TMD-ST secretory sequence, that directs the tagged protein to the Golgi (SEQ ID NO: 189).

Regulatory switches can also be used to fine tune the expression of the FVIII protein so that the FVIII protein is expressed as desired, including but not limited to expression of the FVIII protein at a desired expression level or amount, or alternatively, when there is the presence or absence of particular signal, including a cellular signaling event. For instance, as described herein, expression of the FVIII protein from the ceDNA vector can be turned on or turned off when a particular condition occurs, as described herein in the section entitled Regulatory Switches.

For example, and for illustration purposes only, FVIII proteins can be used to turn off undesired reaction, such as too high a level of production of the FVIII protein. The FVIII gene can contain a signal peptide marker to bring the FVIII protein to the desired cell. However, in either situation it can be desirable to regulate the expression of the FVIII protein. ceDNA vectors readily accommodate the use of regulatory switches.

A distinct advantage of ceDNA vectors over traditional AAV vectors, and even lentiviral vectors, is that there is no size constraint for the heterologous nucleic acid sequences encoding the FVIII protein. Thus, even a full length FVIII, as well as optionally any co-factors or assessor proteins can be expressed from a single ceDNA vector. In addition, depending on the necessary stoichiometry one can express multiple segments of the same FVIII protein, and can use same or different promoters, and can also use regulatory switches to fine tune expression of each region. For example, as shown in the Examples, a ceDNA vector that comprises a dual promoter system can be used, so that a different promoter is used for each domain of the FVIII protein. Use of a ceDNA plasmid to produce the FVIII protein can include a unique combination of promoters for expression of the domains of the FVIII protein that results in the proper ratios of each domain for the formation of functional FVIII protein. Accordingly, in some embodiments, a ceDNA vector can be used to express different regions of FVIII protein separately (e.g., under control of a different promoter).

In another embodiment, the FVIII protein expressed from the ceDNA vectors further comprises an additional functionality, such as fluorescence, enzyme activity, secretion signal or immune cell activator.

In some embodiments, the ceDNA encoding the FVIII protein can further comprise a linker domain, for example. As used herein "linker domain" refers to an oligo- or polypeptide region from about 2 to 100 amino acids in length, which links together any of the domains/regions of the a FVIII protein as described herein. In some embodiment, linkers can include or be composed of flexible residues such as glycine and serine so that the adjacent protein domains are free to move relative to one another. Longer linkers may be used when it is desirable to ensure that two adjacent domains do not sterically interfere with one another. Linkers may be cleavable or non-cleavable. Examples of cleavable linkers include 2A linkers (for example T2A), 2A-like linkers or functional equivalents thereof and combinations thereof. The linker can be a linker region is T2A derived from Thosea asigna virus.

It is well within the abilities of one of skill in the art to take a known and/or publicly available protein sequence of e.g., the FVIII etc., and reverse engineer a cDNA sequence to encode such a protein. The cDNA can then be codon optimized to match the intended host cell and inserted into a ceDNA vector as described herein.

B. ceDNA Vectors Expressing FVIII Protein

A ceDNA vector for expression of FVIII protein having one or more sequences encoding a desired FVIII can comprise regulatory sequences such as promoters, secretion signals, polyA regions, and enhancers. At a minimum, a ceDNA vector comprises one or more heterologous sequences encoding a FVIII protein.

In order to achieve highly efficient and accurate FVIII protein assembly, it is specifically contemplated in some embodiments that the FVIII protein comprise an endoplasmic reticulum ER leader sequence to direct it to the ER, where protein folding occurs. For example, a sequence that directs the expressed protein(s) to the ER for folding.

In some embodiments, a cellular or extracellular localization signal (e.g., secretory signal, nuclear localization signal, mitochondrial localization signal etc.) is comprised in the ceDNA vector to direct the secretion or desired subcellular localization of FVIII such that the FVIII protein can bind to intracellular target(s) (e.g., an intrabody) or extracellular target(s).

In some embodiments, a ceDNA vector for expression of FVIII protein as described herein permits the assembly and expression of any desired FVIII protein in a modular fashion. As used herein, the term "modular" refers to elements in a ceDNA expressing plasmid that can be readily removed from the construct. For example, modular elements in a ceDNA-generating plasmid comprise unique pairs of restriction sites flanking each element within the construct, enabling the exclusive manipulation of individual elements (see e.g., FIGS. 1A-1G). Thus, the ceDNA vector platform can permit the expression and assembly of any desired FVIII protein configuration. Provided herein in various embodiments are ceDNA plasmid vectors that can reduce and/or minimize the amount of manipulation required to assemble a desired ceDNA vector encoding FVIII protein.

C. Exemplary FVIII Proteins Expressed by ceDNA Vectors

In particular, a ceDNA vector for expression of FVIII protein as disclosed herein can encode, for example, but is not limited to, FVIII proteins, as well as variants, and/or active fragments thereof, for use in the treatment, prophylaxis, and/or amelioration of one or more symptoms of hemophilia A. In one aspect, the hemophilia A is a human hemophilia A.

(i) FVIII Therapeutic Proteins and Fragments Thereof

Essentially any version of the FVIII therapeutic protein or fragment thereof (e.g., functional fragment) can be encoded by and expressed in and from a ceDNA vector as described herein. One of skill in the art will understand that FVIII therapeutic protein includes all splice variants and orthologs of the FVIII protein. FVIII therapeutic protein includes intact molecules as well as fragments (e.g., functional) thereof.

Factor VIII

Factor VIII is the nonenzymatic cofactor to the activated clotting factor IX (FIXa), which, when proteolytically activated, interacts with FIXa to form a tight noncovalent complex that binds to and activates factor X (FX).

The Factor VIII gene or protein can also be referred to as F8, Coagulation Factor VIII, Procoagulant Component, Antihemophilic Factor, F8C, AHF, DXS1253E, FVIII, HEMA, or F8B. Expression of the Factor VIII gene is tissue-specific and is mostly observed in liver cells. The highest level of the mRNA and Factor VIII proteins has been detected in liver sinusoidal cells; significant amounts of Factor VIII are also present in hepatocytes and in Kupffer cells (resident macrophages of liver sinusoids). Moderate levels of Factor VIII protein are detectable in the serum and plasma. Low to moderate levels of Factor VIII protein are expressed in fetal brain, retina, kidney and testis.

Factor VIII mRNA is expressed throughout many tissues of the body, including bone marrow, whole blood, white blood cells, lymph nodes, thymus, brain, cerebral cortex, cerebellum, retina, spinal cord, tibial nerve, heart, artery, smooth muscle, skeletal muscle, small intestine, colon, adipocytes, kidney, liver, lung, spleen, stomach, esophagus, bladder, pancreas, thyroid, salivary gland, adrenal gland, pituitary gland, breast, skin, ovary, uterus, placenta, prostate, and testis. The FVIII gene localized on the long arm of the X chromosome occupies a region approximately 186 kbp long and consists of 26 exons (69-3,106 bp) and introns (from 207 bp to 32.4 kbp). The total length of the coding sequence of this gene is 9 kbp.

The mature factor VIII polypeptide comprises the A1-A2-B-A3-C1-C2 structural domains. Three acidic subdomains, which are denoted as a1-a3-A1(a1)-A2(a2)-B-(a3)A3-C1-C2, localize at the boundaries of A domains and play a significant role in the interaction between FVIII and other proteins (in particular, with thrombin). Mutations in these subdomains reduce the level of factor VIII activation by thrombin.

The factor VIII protein (Coagulation factor VIII isoform) is a preproprotein [*Homo sapiens*]; Accession number: NP_000123.1 (2351 aa) and has the following sequence:

(SEQ ID NO: 218)

```
MQIELSTCFFLCLLRFCFSATRRYYLGAVELSWDYMQSDLGELPVDARF
PPRVPKSFPFNTSVVYKKTLFVEFTDHLFNIAKPRPPWMGLLGPTIQAE
VYDTVVITLKNMASHPVSLHAVGVSYWKASEGAEYDDQTSQREKEDDKV
FPGGSHTYVWQVLKENGPMASDPLCLTYSYLSHVDLVKDLNSGLIGALL
VCREGSLAKEKTQTLHKFILLFAVFDEGKSWHSETKNSLMQDRDAASAR
AWPKMHTVNGYVNRSLPGLIGCHRKSVYWHVIGMGTTPEVHSIFLEGHT
FLVRNHRQASLEISPITFLTAQTLLMDLGQFLLFCHISSHQHDGMEAYV
KVDSCPEEPQLRMKNNEEAEDYDDDLTDSEMDVVRFDDDNSPSFIQIRS
VAKKHPKTWVHYIAAEEEDWDYAPLVLAPDDRSYKSQYLNNGPQRIGRK
YKKVRFMAYTDETFKTREAIQHESGILGPLLYGEVGDTLLIIFKNQASR
PYNIYPHGITDVRPLYSRRLPKGVKHLKDFPILPGEIFKYKWTVTVEDG
PTKSDPRCLTRYYSSFVNMERDLASGLIGPLLICYKESVDQRGNQIMSD
KRNVILFSVFDENRSWYLTENIQRFLPNPAGVQLEDPEFQASNIMHSIN
GYVFDSLQLSVCLHEVAYWYILSIGAQTDFLSVFFSGYTFKHKMVYEDT
LTLFPFSGETVFMSMENPGLWILGCHNSDFRNRGMTALLKVSSCDKNTG
DYYEDSYEDISAYLLSKNNAIEPRSFSQNSRHPSTRQKQFNATTIPEND
IEKTDPWFAHRTPMPKIQNVSSSDLLMLLRQSPTPHGLSLSDLQEAKYE
TFSDDPSPGAIDSNNSLSEMTHFRPQLHHSGDMVFTPESGLQLRLNEKL
GTTAATELKKLDFKVSSTSNNLISTIPSDNLAAGTDNTSSLGPPSMPVH
YDSQLDTTLFGKKSSPLTESGGPLSLSEENNDSKLLESGLMNSQESSWG
KNVSSTESGRLFKGKRAHGPALLTKDNALFKVSISLLKTNKTSNNSATN
RKTHIDGPSLLIENSPSVWQNILESDTEFKKVTPLIHDRMLMDKNATAL
RLNHMSNKTTSSKNMEMVQQKKEGPIPPDAQNPDMSFFKMLFLPESARW
IQRTHGKNSLNSGQGPSPKQLVSLGPEKSVEGQNFLSEKNKVVVGKGEF
TKDVGLKEMVFPSSRNLFLTNLDNLHENNTHNQEKKIQEEIEKKETLIQ
ENVVLPQIHTVTGTKNFMKNLFLLSTRQNVEGSYDGAYAPVLQDFRSLN
DSTNRTKKHTAHFSKKGEEENLEGLGNQTKQIVEKYACTTRISPNTSQQ
NFVTQRSKRALKQFRLPLEETELEKRIIVDDTSTQWSKNMKHLTPSTLT
QIDYNEKEKGAITQSPLSDCLTRSHSIPQANRSPLPIAKVSSFPSIRPI
YLTRVLFQDNSSHLPAASYRKKDSGVQESSHFLQGAKKNNLSLAILTLE
MTGDQREVGSLGTSATNSVTYKKVENTVLPKPDLPKTSGKVELLPKVHI
YQKDLFPTETSNGSPGHLDLVEGSLLQGTEGAIKWNEANRPGKVPFLRV
ATESSAKTPSKLLDPLAWDNHYGTQIPKEEWKSQEKSPEKTAFKKKDTI
LSLNACESNHAIAAINEGQNKPEIEVTWAKQGRTERLCSQNPPVLKRHQ
```

-continued

```
REITRTTLQSDQEEIDYDDTISVEMKKEDFDIYDEDENQSPRSFQKKTR
HYFIAAVERLWDYGMSSSPHVLRNRAQSGSVPQFKKVVFQEFTDGSFTQ
PLYRGELNEHLGLLGPYIRAEVEDNIMVTFRNQASRPYSFYSSLISYEE
DQRQGAEPRKNFVKPNETKTYFWKVQHHMAPTKDEFDCKAWAYFSDVDL
EKDVHSGLIGPLLVCHTNTLNPAHGRQVTVQEFALFFTIFDETKSWYFT
ENMERNCRAPCNIQMEDPTFKENYRFHAINGYIMDTLPGLVMAQDQRIR
WYLLSMGSNENIHSIHFSGHVFTVRKKEEYKMALYNLYPGVFETVEMLP
SKAGIWRVECLIGEHLHAGMSTLFLVYSNKCQTPLGMASGHIRDFQITA
SGQYGQWAPKLARLHYSGSINAWSTKEPFSWIKVDLLAPMIIHGIKTQG
ARQKFSSLYISQFIIMYSLDGKKWQTYRGNSTGTLMVFFGNVDSSGIKH
NIFNPPIIARYIRLHPTHYSIRSTLRMELMGCDLNSCSMPLGMESKAIS
DAQITASSYFTNMFATWSPSKARLHLQGRSNAWRPQVNNPKEWLQVDFQ
KTMKVTGVTTQGVKSLLTSMYVKEFLISSSQDGHQWTLFFQNGKVKVFQ
GNQDSFTPVVNSLDPPLLTRYLRIHPQSWVHQIALRMEVLGCEAQDLY
```

A distinct advantage of ceDNA vectors over traditional AAV vectors, and even lentiviral vectors, is that there is no size constraint for the heterologous nucleic acid sequences encoding a desired protein. Thus, multiple full length FVIII therapeutic proteins can be expressed from a single ceDNA vector.

Expression of FVIII therapeutic protein or fragment thereof from a ceDNA vector can be achieved both spatially and temporally using one or more inducible or repressible promoters, as known in the art or described herein, including regulatory switches as described herein.

In one embodiment, FVIII therapeutic protein is an "therapeutic protein variant," which refers to the FVIII therapeutic protein having an altered amino acid sequence, composition or structure as compared to its corresponding native FVIII therapeutic protein. In one embodiment, FVIII is a functional version (e.g., wild type). It may also be useful to express a mutant version of FVIII protein such as a point mutation or deletion mutation that leads to hemophilia A, e.g., for an animal model of the disease and/or for assessing drugs for hemophilia A. Delivery of mutant or modified FVIII proteins to a cell or animal model system can be done in order to generate a disease model. Such a cellular or animal model can be used for research and/or drug screening. FVIII therapeutic protein expressed from the ceDNA vectors may further comprise a sequence/moiety that confers an additional functionality, such as fluorescence, enzyme activity, or secretion signal. In one embodiment, an FVIII therapeutic protein variant comprises a non-native tag sequence for identification (e.g., an immunotag) to allow it to be distinguished from endogenous FVIII therapeutic protein in a recipient host cell.

It is well within the abilities of one of skill in the art to take a known and/or publicly available protein sequence of e.g., FVIII therapeutic protein and reverse engineer a cDNA sequence to encode such a protein. The cDNA can then be codon optimized to match the intended host cell and inserted into a ceDNA vector as described herein.

In one embodiment, the FVIII therapeutic protein encoding sequence can be derived from an existing host cell or cell line, for example, by reverse transcribing mRNA obtained from the host and amplifying the sequence using PCR.

(ii) FVIII Therapeutic Protein Expressing ceDNA Vectors

A ceDNA vector having one or more sequences encoding a desired FVIII therapeutic protein can comprise regulatory sequences such as promoters, secretion signals, polyA regions, and enhancers. At a minimum, a ceDNA vector comprises one or more heterologous sequences encoding the FVIII therapeutic protein or functional fragment thereof. Exemplary cassette inserts for generating ceDNA vectors encoding the FVIII therapeutic proteins are depicted in FIGS. 1A-1G. In one embodiment, the ceDNA vector comprises an FVIII sequence listed in Table 1 herein.

TABLE 1

| Exemplary FVIII sequences for treatment of hemophilia A<br>Exemplary nucleic acid sequences encoding Factor VIII | | | | | |
|---|---|---|---|---|---|
| Description | Length | Ref-erence | CG Content | SEQ ID NO: | Sequence |
| B domain-deleted (BDD) hEVIII with SQ sequence I | 4374 | https://www.ncbi.nlm.nih.gov/pubmed/29292164 | 3 | 380 | ATGCAGATTGAGCTGAGCACCTGCTTCTTCCTGTGCCTGCTGAGGTTCTGCTTCTCTGCCACCAGGAGATACTACCTGGG<br>GGCTGTGGAGCTGAGCTGGGACTACATGCAGTCTGACCTGGGGGAGCTGCCTGTGGATGCCAGGTTCCCCCCCAGAGT<br>GCCCAAGAGCTTCCCCTTCAACACCTCTGTGGTGTACAAGAAGACCCTGTTTGTGGAGTTCACTGACCACCTGTTCAACA<br>TTGCCAAGCCCAGGCCCCCCTGGATGGGCCTGCTGGGCCCCACCATCCAGGCTGAGGTGTATGACACTGTGGTGATCAC<br>CCTGAAGAACATGGCCAGCCACCCTGTGAGCCTGCATGCTGTGGGGGTGAGCTACTGGAAGGCCTCTGAGGGGGCTGA<br>GTATGATGACCAGACCAGCCAGAGGGAGAAGGAGGATGACAAGGTGTTCCCTGGGGGCAGCCACACCTATGTGTGGC<br>AGGTGCTGAAGGAGAATGGCCCCATGGCCTCTGACCCCCTGTGCCTGACCTACAGCTACCTGAGCCATGTGGACCTGGT<br>GAAGGACCTGAACTCTGGCCTGATTGGGGCCCTGCTGGTGTGCAGGGAGGGCAGCCTGGCCAAGGAGAAGACCCAGA<br>CCCTGCACAAGTTCATCCTGCTGTTTGCTGTGTTTGATGAGGGCAAGAGCTGGCACTCTGAAACCAAGAACAGCCTGAT<br>GCAGGACAGGGATGCTGCCTCTGCCAGGGCCTGGCCCAAGATGCACACTGTGAATGGCTATGTGAACAGGAGCCTGCC<br>TGGCCTGATTGGCTGCCACAGGAAGTCTGTGTACTGGCATGTGATTGGCATGGGCACCACCCCTGAGGTGCACAGCATC<br>TTCCTGGAGGGCCACACCTTCCTGGTCAGGAACCACAGGCAGGCCAGCCTGGAGATCAGCCCCATCACCTTCCTGACTG<br>CCCAGACCCTGCTGATGGACCTGGGCCAGTTCCTGCTGTTCTGCCACATCAGCAGCCACCAGCATGATGGCATGGAGGC<br>CTATGTGAAGGTGGACAGCTGCCCTGAGGAGCCCCAGCTGAGGATGAAGAACAATGAGGAGGCTGAGGACTATGATG<br>ATGACCTGACTGACTCTGAGATGGATGTGGTGAGGTTTGATGATGACAACAGCCCCAGCTTCATCCAGATCAGGTCTGT<br>GGCCAAGAAGCACCCCAAGACCTGGGTGCACTACATTGCTGCTGAGGAGGAGGACTGGGACTATGCCCCCCTGGTGCT<br>GGCCCCTGATGACAGGAGCTACAAGAGCCAGTACCTGAACAATGGCCCCCAGAGGATTGGCAGGAAGTACAAGAAGG<br>TCAGGTTCATGGCCTACACTGATGAAACCTTCAAGACCAGGGAGGCCATCCAGCATGAGTCTGGCATCCTGGGCCCCCT<br>GCTGTATGGGGAGGTGGGGGACACCCTGCTGATCATCTTCAAGAACCAGGCCAGCAGGCCCTACAACATCTACCCCCAT<br>GGCATCACTGATGTGAGGCCCCTGTACAGCAGGAGGCTGCCCAAGGGGGTGAAGCACCTGAAGGACTTCCCCATCCTG<br>CCTGGGGAGATCTTCAAGTACAAGTGGACTGTGACTGTGGAGGATGGCCCCACCAAGTCTGACCCCAGGTGCCTGACC<br>AGATACTACAGCAGCTTTGTGAACATGGAGAGGGACCTGGCCTCTGGCCTGATTGGCCCCCTGCTGATCTGCTACAAGG<br>AGTCTGTGGACCAGAGGGGCAACCAGATCATGTCTGACAAGAGGAATGTGATCCTGTTCTCTGTGTTTGATGAGAACA<br>GGAGCTGGTACCTGACTGAGAACATCCAGAGGTTCCTGCCCAACCCTGCTGGGGTGCAGCTGGAGGACCCTGAGTTCC<br>AGGCCAGCAACATCATGCACAGCATCAATGGCTATGTGTTTGACAGCCTGCAGCTGTCTGTGTGCCTGCATGAGGTGGC<br>CTACTGGTACATCCTGAGCATTGGGGCCCAGACTGACTTCCTGTCTGTGTTCTTCTCTGGCTACACCTTCAAGCACAAGAT<br>GGTGTATGAGGACACCCTGACCCTGTTCCCCTTCTCTGGGGAGACTGTGTTCATGAGCATGGAGAACCCTGGCCTGTGG<br>ATTCTGGGCTGCCACAACTCTGACTTCAGGAACAGGGGCATGACTGCCCTGCTGAAAGTCTCCAGCTGTGACAAGAACA<br>CTGGGGACTACTATGAGGACAGCTATGAGGACATCTCTGCCTACCTGCTGAGCAAGAACAATGCCATTGAGCCCAGGA<br>GCTTCAGCCAGAACCCCCCAGTGCTGAAGAGGCACCAGAGGGAGATCACCAGGACCACCCTGCAGTCTGACCAGGAGG<br>AGATTGACTATGATGACACCATCTCTGTGGAGATGAAGAAGGAGGACTTTGACATCTACGACGAGGACGAGAACCAGA<br>GCCCCAGGAGCTTCCAGAAGAAGACCAGGCACTACTTCATTGCTGCTGTGGAGAGGCTGTGGGACTATGGCATGAGCA<br>GCAGCCCCCATGTGCTGAGGAACAGGGCCCAGTCTGGCTCTGTGCCCCAGTTCAAGAAGGTGGTGTTCCAGGAGTTCA<br>CTGATGGCAGCTTCACCCAGCCCCTGTACAGAGGGGAGCTGAATGAGCACCTGGGCCTGCTGGGCCCCTACATCAGGG<br>CTGAGGTGGAGGACAACATCATGGTGACCTTCAGGAACCAGGCCAGCAGGCCCTACAGCTTCTACAGCAGCCTGATCA<br>GCTATGAGGAGGACCAGAGGCAGGGGGCTGAGCCCAGGAAGAACTTTGTGAAGCCCAATGAAACCAAGACCTACTTCT<br>GGAAGGTGCAGCACCACATGGCCCCCACCAAGGATGAGTTTGACTGCAAGGCCTGGGCCTACTTCTCTGATGTGGACCT<br>GGAGAAGGATGTGCACTCTGGCCTGATTGGCCCCCTGCTGGTGTGCCACACCAACACCCTGAACCCTGCCCATGGCAGG<br>CAGGTGACTGTGCAGGAGTTTGCCCTGTTCTTCACCATCTTTGATGAAACCAAGAGCTGGTACTTCACTGAGAACATGG<br>AGAGGAACTGCAGGGCCCCCTGCAACATCCAGATGGAGGACCCCACCTTCAAGGAGAACTACAGGTTCCATGCCATCA<br>ATGGCTACATCATGGACACCCTGCCTGGCCTGGTGATGGCCCAGGACCAGAGGATCAGGTGGTACCTGCTGAGCATGG<br>GCAGCAATGAGAACATCCACAGCATCCACTTCTCTGGCCATGTGTTCACTGTGAGGAAGAAGGAGGAGTACAAGATGG<br>CCCTGTACAACCTGTACCCTGGGGTGTTTGAGACTGTGGAGATGCTGCCCAGCAAGGCTGGCATCTGGAGGGTGGAGT<br>GCCTGATTGGGGAGCACCTGCATGCTGGCATGAGCACCCTGTTCCTGGTGTACAGCAACAAGTGCCAGACCCCCCTGGG |

TABLE 1-continued

Exemplary FVIII sequences for treatment of hemophilia A
Exemplary nucleic acid sequences encoding Factor VIII

| Description | Length | Ref-erence | CG Content | SEQ ID NO: | Sequence |
|---|---|---|---|---|---|
| | | | | | CATGGCCTCTGGCCACATCAGGGACTTCCAGATCACTGCCTCTGGCCAGTATGGCCAGTGGGCCCCCAAGCTGGCCAGG<br>CTGCACTACTCTGGCAGCATCAATGCCTGGAGCACCAAGGAGCCCTTCAGCTGGATCAAGGTGGACCTGCTGGCCCCCA<br>TGATCATCCATGGCATCAAGACCCAGGGGGCCAGGCAGAAGTTCAGCAGCCTGTACATCAGCCAGTTCATCATCATGTA<br>CAGCCTGGATGGCAAGAAGTGGCAGACCTACAGGGGCAACAGCACTGGCACCCTGATGGTGTTCTTTGGCAATGTGGA<br>CAGCTCTGGCATCAAGCACAACATCTTCAACCCCCCCATCATTGCCAGATACATCAGGCTGCACCCCACCCACTACAGCA<br>TCAGGAGCACCCTGAGGATGGAGCTGATGGGCTGTGACCTGAACAGCTGCAGCATGCCCCTGGGCATGGAGAGCAAG<br>GCCATCTCTGATGCCCAGATCACTGCCAGCAGCTACTTCACCAACATGTTTGCCACCTGGAGCCCCAGCAAGGCCAGGCT<br>GCACCTGCAGGGCAGGAGCAATGCCTGGAGGCCCCAGGTCAACAACCCCAAGGAGTGGCTGCAGGTGGACTTCCAGA<br>AGACCATGAAGGTGACTGGGGTGACCACCCAGGGGGTGAAGAGCCTGCTGACCAGCATGTATGTGAAGGAGTTCCTG<br>ATCAGCAGCAGCCAGGATGGCCACCAGTGGACCCTGTTCTTCCAGAATGGCAAGGTGAAGGTGTTCCAGGGCAACCAG<br>GACAGCTTCACCCCTGTGGTGAACAGCCTGGACCCCCCCCTGCTGACCAGATACCTGAGGATTCACCCCCAGAGCTGGG<br>TGCACCAGATTGCCCTGAGGATGGAGGTGCTGGGCTGTGAGGCCCAGGACCTGTACTGA |
| B domain-deleted (BDD) hEVIII with SQ sequence II | 4374 | US2017 0216408 A1 | 0 | 381 | ATGCAGATTGAGCTGAGCACCTGCTTCTTCCTGTGTCTGCTGAGGTTCTGCTTCTCTGCCACCAGGAGGTATTACCTGGG<br>GGCTGTGGAGCTGAGCTGGGACTATATGCAGTCTGACCTGGGGGAGCTGCCTGTGGATGCTAGGTTCCCCCCCAGGGT<br>GCCCAAGAGCTTCCCCTTTAACACTTCTGTGGTGTACAAGAAGACCCTGTTTGTGGAGTTCACTGACCACCTGTTCAACA<br>TTGCCAAGCCCAGGCCCCCCTGGATGGGGCTGCTGGGGCCCACCATCCAGGCTGAGGTGTATGACACTGTGGTGATCA<br>CCCTGAAGAACATGGCCAGCCACCCTGTGAGCCTGCATGCTGTGGGGGTGAGCTACTGGAAGGCTTCTGAGGGGGCTG<br>AGTATGATGACCAGACTAGCCAGAGGGAGAAGGAGGATGACAAGGTGTTTCCTGGGGGCAGCCATACCTATGTGTGG<br>CAGGTGCTGAAGGAGAATGGCCCCATGGCCTCTGACCCCCTGTGCCTGACCTACAGCTACCTGTCTCATGTGGACCTGG<br>TGAAGGACCTGAACTCTGGCCTGATTGGGGCTCTGCTGGTGTGTAGGGAGGGCAGCCTGGCTAAGGAAAAGACCCAG<br>ACCCTGCATAAGTTTATCCTGCTGTTTGCTGTGTTTGATGAGGGCAAGAGCTGGCACTCTGAGACCAAGAACAGCCTGA<br>TGCAGGATAGGGATGCTGCCTCTGCCAGGGCTGGCCTAAGATGCACACTGTGAATGGGTATGTGAATAGGAGCCTGC<br>CTGGCCTGATTGGCTGCCACAGGAAGTCTGTGTACTGGCATGTGATTGGGATGGGCACCACCCCTGAGGTCCATAGCAT<br>CTTCCTGGAGGGCCACACTTTCCTGGTGAGGAACCACAGACAGGCCTCTCTGGAGATCTCTCCCATCACCTTCCTGACTG<br>CTCAGACTCTGCTGATGGACCTGGGCCAGTTCCTGCTGTTTTGCCATATTAGCAGCCACCAGCATGATGGGATGGAGGC<br>CTATGTGAAGGTGGATAGCTGCCCTGAGGAGCCTCAGCTGAGGATGAAGAACAATGAGGAGGCTGAAGACTATGATG<br>ATGACCTGACTGATTCTGAGATGGATGTGGTGAGGTTTGATGATGACAATAGCCCCAGCTTCATTCAGATCAGGTCTGT<br>GGCCAAGAAACACCCCAAGACCTGGGTGCACTACATTGCTGCTGAGGAAGAGGACTGGGACTATGCTCCCCTGGTGCT<br>GGCCCCTGATGATAGGTCTTATAAGAGCCAGTACCTGAACAATGGGCCCCAGAGGATTGGCAGGAAGTACAAGAAGGT<br>GAGGTTCATGGCCTACACTGATGAAACCTTCAAAACCAGGGAGGCCATTCAGCATGAGTCTGGCATCCTGGGCCCTCTG<br>CTGTATGGGGAGGTGGGGGACACCCTGCTGATCATCTTCAAGAACCAGGCCAGCAGGCCCTACAACATCTATCCTCATG<br>GCATCACTGATGTGAGGCCCCTGTACAGCAGGAGGCTGCCCAAGGGGGTGAAGCACCTGAAAGACTTCCCCATCCTGC<br>CTGGGGAGATCTTTAAGTATAAGTGGACTGTGACTGTGGAGGATGGCCCTACCAAGTCTGACCCCAGGTGTCTGACCA<br>GGTACTATTCTAGCTTTGTGAACATGGAGAGGGACCTGGCCTCTGGCCTGATTGGGCCCCTGCTGATCTGCTACAAGGA<br>GTCTGTGGACCAGAGGGGCAACCAGATCATGTCTGACAAGAGGAATGTGATCCTGTTTTCTGTGTTTGATGAGAATAGG<br>AGCTGGTACCTGACTGAGAACATCCAGAGGTTTCTGCCCAATCCTGCTGGGGTGCAGCTGGAGGATCCTGAGTTCCAGG<br>CCAGCAATATCATGCATAGCATCAATGGCTATGTGTTTGACAGCCTGCAGCTGTCTGTGTGCCTGCATGAGGTGGCCTAC<br>TGGTACATCCTGAGCATGGGGCCCAGACTGACTTTCTGTCTGTGTTCTTTTCTGGCTATACCTTCAAGCACAAGATGGT<br>GTATGAGGATACCCTGACCCTGTTCCCCTTCTCTGGGGAGACTGTGTTCATGAGCATGGAGAATCCTGGGCTGTGGATC<br>CTGGGGTGCCACAACTCTGATTTTAGGAACAGGGGGATGACTGCCCTGCTGAAGGTGTCTAGCTGTGATAAGAACACT<br>GGGGACTACTATGAGGACAGCTATGAGGACATTTCTGCTTATCTGCTGTCTAAGAATAATGCCATTGAGCCCAGAAGCT<br>TCAGCCAGAATCCCCCTGTGCTGAAGAGACATCAGAGGGAGATCACCAGAACTACCCTGCAGTCTGATCAGGAGGAGA<br>TTGACTATGATGACACTATCTCTGTGGAGATGAAGAAGGAGGACTTTGACATCTATGATGAGGATGAGAATCAGTCTCC<br>CAGGAGCTTTCAGAAGAAGACCAGACATTACTTCATTGCTGCTGTGGAGAGGCTGTGGGACTATGGCATGAGCTCTAG<br>CCCTCATGTGCTGAGGAACAGGGCCCAGTCTGGCTCTGTGCCCCAGTTCAAGAAGGTGGTGTTCCAGGAATTCACTGAT |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | GGCAGCTTCACCCAGCCCCTGTACAGGGGGGAGCTGAATGAGCACCTGGGCCTGCTGGGGCCTTATATCAGGGCTGAG<br>GTGGAGGATAATATTATGGTGACTTTCAGGAACCAGGCCAGCAGGCCCTACTCTTTCTATAGCAGCCTGATCTCTTATGA<br>GGAGGATCAGAGGCAGGGGGCTGAGCCTAGGAAGAACTTTGTGAAGCCCAATGAGACTAAGACCTACTTCTGGAAGG<br>TCCAGCACCACATGGCCCCTACCAAGGATGAGTTTGACTGCAAGGCCTGGGCCTATTTCTCTGATGTGGATCTGGAGAA<br>GGATGTCCATTCTGGGCTGATTGGCCCCCTGCTGGTGTGCCACACTAACACTCTGAATCCTGCCCATGGCAGGCAGGTG<br>ACTGTCCAGGAGTTTGCCCTGTTCTTCACTATCTTTGATGAGACCAAGAGCTGGTACTTTACTGAGAACATGGAGAGGA<br>ACTGCAGAGCTCCTTGCAATATTCAGATGGAGGACCCCACCTTCAAGGAGAATTACAGGTTCCATGCCATTAATGGGTA<br>CATCATGGACACCCTGCCTGGCCTGGTGATGGCTCAGGACCAGAGGATCAGGTGGTACCTGCTGAGCATGGGCTCTAA<br>TGAGAATATCCACAGCATCCACTTCTCTGGGCATGTGTTCACTGTGAGGAAGAAGGAGGAGTACAAGATGGCTCTGTAT<br>AATCTGTACCCTGGGGTGTTTGAAACTGTGGAGATGCTGCCCTCTAAGGCTGGCATCTGGAGGGTGGAGTGCCTGATG<br>GGGAGCACCTGCATGCTGGCATGAGCACCCTGTTCCTGGTGTACAGCAACAAGTGCCAGACCCCCCTGGGCATGGCCTC<br>TGGCCACATCAGGGACTTCCAGATCACTGCCTCTGGCCAGTATGGCCAGTGGGCCCCCAAGCTGGCCAGGCTGCACTAT<br>TCTGGCAGCATCAATGCCTGGAGCACCAAGGAGCCCTTCAGCTGGATCAAGGTGGACCTGCTGGCCCCCATGATCATTC<br>ATGGCATCAAGACCCAGGGGGCCAGGCAGAAGTTCAGCTCTCTGTACATCTCTCAGTTCATCATCATGTACTCTCTGGAT<br>GGGAAGAAGTGGCAGACCTACAGGGGCAACAGCACTGGCACCCTGATGGTGTTCTTTGGGAATGTGGACTCTTCTGGC<br>ATCAAGCACAACATCTTCAATCCCCCCATCATTGCTAGGTATATTAGGCTGCATCCCACCCACTACAGCATCAGGTCTACC<br>CTGAGGATGGAGCTGATGGGCTGTGACCTGAACTCTTGCAGCATGCCCCTGGGCATGGAGTCTAAGGCCATCTCTGATG<br>CCCAGATTACTGCCAGCAGCTACTTCACCAACATGTTTGCCACCTGGAGCCCCTCTAAGGCCAGGCTGCATCTGCAGGG<br>GAGGAGCAATGCCTGGAGGCCTCAGGTGAACAACCCCAAGGAGTGGCTGCAGGTGGATTTCCAGAAGACCATGAAGG<br>TGACTGGGGTGACCACCCAGGGGGTCAAGAGCCTGCTGACCAGCATGTATGTGAAGGAGTTCCTGATCAGCAGCAGCC<br>AGGATGGCCACCAGTGGACTCTGTTCTTTCAGAATGGGAAGGTGAAGGTGTTTCAGGGCAATCAGGACTCTTTCACCCC<br>TGTGGTGAACAGCCTGGACCCCCCCCTGCTGACCAGATACCTGAGGATCCACCCCCAGTCTTGGGTGCATCAGATTGCC<br>CTGAGGATGGAGGTGCTGGGCTGTGAGGCTCAGGATCTGTACTGA |
| B domain-deleted (BDD) hFVIII with SQ sequencel II | 4374 | WO2017074526A1 | 9 | 382 | ATGCAGATCGAGCTCTCCACCTGCTTCTTTCTGTGCCTGTTGAGATTCTGCTTCAGCGCCACCAGGAGATACTACCTGGG<br>GGCTGTGGAGCTGAGCTGGGACTACATGCAGTCTGACCTGGGGGAGCTGCCTGTGGATGCCAGGTTCCCCCCCAGAGT<br>GCCCAAGAGCTTCCCCTTCAACACCTCTGTGGTGTACAAGAAGACCCTGTTTGTGGAGTTCACTGACCACCTGTTCAACA<br>TTGCCAAGCCCAGGCCCCCCTGGATGGGCCTGCTGGGCCCCACCATCCAGGCTGAGGTGTATGACACTGTGGTGATCAC<br>CCTGAAGAACATGGCCAGCCACCCTGTGAGCCTGCATGCTGTGGGGGTGAGCTACTGGAAGGCCTCTGAGGGGGCTGA<br>GTATGATGACCAGACCAGCCAGAGGGAGAAGGAGGATGACAAGGTGTTCCCTGGGGGCAGCCACACCTATGTGTGGC<br>AGGTGCTGAAGGAGAATGGCCCCATGGCCTCTGACCCCCTGTGCCTGACCTACAGCTACCTGAGCCATGTGGACCTGGT<br>GAAGGACCTGAACTCTGGCCTGATTGGGGCCCTGCTGGTGTGCAGGGAGGGCAGCCTGGCCAAGGAGAAGACCCAGA<br>CCCTGCACAAGTTCATCCTGCTGTTTGCTGTGTTTGATGAGGGCAAGAGCTGGCACTCTGAAACCAAGAACAGCCTGAT<br>GCAGGACAGGGATGCTGCCTCTGCCAGGGCCTGGCCCAAGATGCACACTGTGAATGGCTATGTGAACAGGAGCCTGCC<br>TGGCCTGATTGGCTGCCACAGGAAGTCTGTGTACTGGCATGTGATTGGCATGGGCACCACCCCTGAGGTGCACAGCATC<br>TTCCTGGAGGGCCACACCTTCCTGGTCAGGAACCACAGGCAGGCCAGCCTGGAGATCAGCCCCATCACCTTCCTGACTG<br>CCCAGACCCTGCTGATGGACCTGGGCCAGTTCCTGCTGTTCTGCCACATCAGCAGCCACCAGCATGATGGCATGGAGGC<br>CTATGTGAAGGTGGACAGCTGCCCTGAGGAGCCCCAGCTGAGGATGAAGAACAATGAGGAGGCTGAGGACTATGATG<br>ATGACCTGACTGACTCTGAGATGGATGTGGTGAGGTTTGATGATGACAACAGCCCCAGCTTCATCCAGATCAGGTCTGT<br>GGCCAAGAAGCACCCCAAGACCTGGGTGCACTACATTGCTGCTGAGGAGGAGGACTGGGACTATGCCCCCCTGGTGCT<br>GGCCCCTGATGACAGGAGCTACAAGAGCCAGTACCTGAACAATGGCCCCCAGAGGATTGGCAGGAAGTACAAGAAGG<br>TCAGGTTCATGGCCTACACTGATGAAACCTTCAAGACCAGGGAGGCCATCCAGCATGAGTCTGGCATCCTGGGCCCCCT<br>GCTGTATGGGGAGGTGGGGGACACCCTGCTGATCATCTTCAAGAACCAGGCCAGCAGGCCCTACAACATCTACCCCCAT<br>GGCATCACTGATGTGAGGCCCCTGTACAGCAGGAGGCTGCCCAAGGGGGTGAAGCACCTGAAGGACTTCCCCATCCTG<br>CCTGGGGAGATCTTCAAGTACAAGTGGACTGTGACTGTGGAGGATGGCCCCACCAAGTCTGACCCCAGGTGCCTGACC<br>AGATACTACAGCAGCTTTGTGAACATGGAGAGGGACCTGGCCTCTGGCCTGATGGCCCCCTGCTGATCTGCTACAAGG |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | AGTCTGTGGACCAGAGGGGCAACCAGATCATGTCTGACAAGAGGAATGTGATCCTGTTCTCTGTGTTTGATGAGAACA<br>GGAGCTGGTACCTGACTGAGAACATCCAGAGGTTCCTGCCCAACCCTGCTGGGGTGCAGCTGGAGGACCCTGAGTTCC<br>AGGCCAGCAACATCATGCACAGCATCAATGGCTATGTGTTTGACAGCCTGCAGCTGTCTGTGTGCCTGCATGAGGTGGC<br>CTACTGGTACATCCTGAGCATTGGGGCCCAGACTGACTTCCTGTCTGTGTTCTTCTCTGGCTACACCTTCAAGCACAAGAT<br>GGTGTATGAGGACACCCTGACCCTGTTCCCCTTCTCTGGGGAGACTGTGTTCATGAGCATGGAGAACCCTGGCCTGTGG<br>ATTCTGGGCTGCCACAACTCTGACTTCAGGAACAGGGGCATGACTGCCCTGCTGAAAGTCTCCAGCTGTGACAAGAACA<br>CTGGGGACTACTATGAGGACAGCTATGAGGACATCTCTGCCTACCTGCTGAGCAAGAACAATGCCATTGAGCCCAGGA<br>GCTTCAGCCAGAATCCACCCGTCCTTAAGCGCCATCAGCGCGAGATCACCAGGACCACCCTGCAGTCTGACCAGGAGGA<br>GATTGACTATGATGACACCATCTCTGTGGAGATGAAGAAGGAGGACTTTGACATCTACGACGAGGACGAGAACCAGAG<br>CCCCAGGAGCTTCCAGAAGAAGACCAGGCACTACTTCATTGCTGCTGTGGAGAGGCTGTGGGACTATGGCATGAGCAG<br>CAGCCCCCATGTGCTGAGGAACAGGGCCCAGTCTGGCTCTGTGCCCCAGTTCAAGAAGGTGGTGTTCCAGGAGTTCACT<br>GATGGCAGCTTCACCCAGCCCCTGTACAGAGGGGAGCTGAATGAGCACCTGGGCCTGCTGGGCCCCTACATCAGGGCT<br>GAGGTGGAGGACAACATCATGGTGACCTTCAGGAACCAGGCCAGCAGGCCCTACAGCTTCTACAGCAGCCTGATCAGC<br>TATGAGGAGGACCAGAGGCAGGGGGCTGAGCCCAGGAAGAACTTTGTGAAGCCCAATGAAACCAAGACCTACTTCTG<br>GAAGGTGCAGCACCACATGGCCCCCACCAAGGATGAGTTTGACTGCAAGGCCTGGGCCTACTTCTCTGATGTGGACCTG<br>GAGAAGGATGTGCACTCTGGCCTGATTGGCCCCCTGCTGGTGTGCCACACCAACACCCTGAACCCTGCCCATGGCAGGC<br>AGGTGACTGTGCAGGAGTTTGCCCTGTTCTTCACCATCTTTGATGAAACCAAGAGCTGGTACTTCACTGAGAACATGGA<br>GAGGAACTGCAGGGCCCCCTGCAACATCCAGATGGAGGACCCCACCTTCAAGGAGAACTACAGGTTCCATGCCATCAAT<br>GGCTACATCATGGACACCCTGCCTGGCCTGGTGATGGCCCAGGACCAGAGGATCAGGTGGTACCTGCTGAGCATGGGC<br>AGCAATGAGAACATCCACAGCATCCACTTCTCTGGCCATGTGTTCACTGTGAGGAAGAAGGAGGAGTACAAGATGGCC<br>CTGTACAACCTGTACCCTGGGGTGTTTGAGACTGTGGAGATGCTGCCCAGCAAGGCTGGCATCTGGAGGGTGGAGTGC<br>CTGATTGGGGAGCACCTGCATGCTGGCATGAGCACCCTGTTCCTGGTGTACAGCAACAAGTGCCAGACCCCCCTGGGCA<br>TGGCCTCTGGCCACATCAGGGACTTCCAGATCACTGCCTCTGGCCAGTATGGCCAGTGGGCCCCCAAGCTGGCCAGGCT<br>GCACTACTCTGGCAGCATCAATGCCTGGAGCACCAAGGAGCCCTTCAGCTGGATCAAGGTGGACCTGCTGGCCCCCATG<br>ATCATCCATGGCATCAAGACCCAGGGGGCCAGGCAGAAGTTCAGCAGCCTGTACATCAGCCAGTTCATCATCATGTACA<br>GCCTGGATGGCAAGAAGTGGCAGACCTACAGGGGCAACAGCACTGGCACCCTGATGGTGTTCTTTGGCAATGTGGACA<br>GCTCTGGCATCAAGCACAACATCTTCAACCCCCCCATCATTGCCAGATACATCAGGCTGCACCCCACCCACTACAGCATC<br>AGGAGCACCCTGAGGATGGAGCTGATGGGCTGTGACCTGAACAGCTGCAGCATGCCCCTGGGCATGGAGAGCAAGGC<br>CATCTCTGATGCCCAGATCACTGCCAGCAGCTACTTCACCAACATGTTTGCCACCTGGAGCCCCAGCAAGGCCAGGCTGC<br>ATCTGCAGGGCAGGAGCAATGCCTGGAGGCCCCAGGTCAACAACCCCAAGGAGTGGCTGCAGGTGGACTTCCAGAAG<br>ACCATGAAGGTGACTGGGGTGACCACCCAGGGGGTGAAGAGCCTGCTGACCAGCATGTATGTGAAGGAGTTCCTGATC<br>AGCAGCAGCCAGGATGGCCACCAGTGGACCCTGTTCTTCCAGAATGGCAAGGTGAAGGTGTTCCAGGGCAACCAGGAC<br>AGCTTCACCCCTGTGGTGAACAGCCTGGACCCCCCCCTGCTGACCAGATACCTGAGGATTCACCCCCAGAGCTGGGTGC<br>ACCAGATTGCCCTGAGGATGGAGGTGCTGGGCTGTGAGGCCCAGGACCTGTACTGA |
| Endogenous hFVIII cDNA | 7056 | NG_011403.1 | 70 | 383 | ATGCAAATAGAGCTCTCCACCTGCTTCTTTCTGTGCCTTTTGCGATTCTGCTTTAGTGCCACCAGAAGATACTACCTGGGT<br>GCAGTGGAACTGTCATGGGACTATATGCAAAGTGATCTCGGTGAGCTGCCTGTGGACGCAAGATTTCCTCCTAGAGTGC<br>CAAAATCTTTTCCATTCAACACCTCAGTCGTGTACAAAAAGACTCTGTTTGTAGAATTCACGGATCACCTTTTCAACATCG<br>CTAAGCCAAGGCCACCCTGGATGGGTCTGCTAGGTCCTACCATCCAGGCTGAGGTTTATGATACAGTGGTCATTACACTT<br>AAGAACATGGCTTCCCATCCTGTCAGTCTTCATGCTGTTGGTGTATCCTACTGGAAAGCTTCTGAGGGAGCTGAATATGA<br>TGATCAGACCAGTCAAAGGGAGAAAGAAGATGATAAAGTCTTCCCTGGTGGAAGCCATACATATGTCTGGCAGGTCCT<br>GAAAGAGAATGGTCCAATGGCCTCTGACCCACTGTGCCTTACCTACTCATATCTTTCTCATGTGGACCTGGTAAAAGACT<br>TGAATTCAGGCCTCATTGGAGCCCTACTAGTATGTAGAGAAGGGAGTCTGGCCAAGGAAAAGACACAGACCTTGCACA<br>AATTTATACTACTTTTTGCTGTATTTGATGAAGGGAAAAGTTGGCACTCAGAAACAAAGAACTCCTTGATGCAGGATAG<br>GGATGCTGCATCTGCTCGGGCCTGGCCTAAAATGCACACAGTCAATGGTTATGTAAACAGGTCTCTGCCAGGTCTGATT<br>GGATGCCACAGGAAATCAGTCTATTGGCATGTGATTGGAATGGGCACCACTCCTGAAGTGCACTCAATATTCCTCGAAG |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | GTCACACATTTCTTGTGAGGAACCATCGCCAGGCGTCCTTGGAAATCTCGCCAATAACTTTCCTTACTGCTCAAACACTCT<br>TGATGGACCTTGGACAGTTTCTACTGTTTTGTCATATCTCTTCCCACCAACATGATGGCATGGAAGCTTATGTCAAAGTA<br>GACAGCTGTCCAGAGGAACCCCAACTACGAATGAAAAATAATGAAGAAGCGGAAGACTATGATGATGATCTTACTGAT<br>TCTGAAATGGATGTGGTCAGGTTTGATGATGACAACTCTCCTTCCTTTATCCAAATTCGCTCAGTTGCCAAGAAGCATCCT<br>AAAACTTGGGTACATTACATTGCTGCTGAAGAGGAGGACTGGGACTATGCTCCCTTAGTCCTCGCCCCCGATGACAGAA<br>GTTATAAAAGTCAATATTTGAACAATGGCCCTCAGCGGATTGGTAGGAAGTACAAAAAAGTCCGATTTATGGCATACAC<br>AGATGAAACCTTTAAGACTCGTGAAGCTATTCAGCATGAATCAGGAATCTTGGGACCTTTACTTTATGGGGAAGTTGGA<br>GACACACTGTTGATTATATTTAAGAATCAAGCAAGCAGACCATATAACATCTACCCTCACGGAATCACTGATGTCCGTCC<br>TTTGTATTCAAGGAGATTACCAAAAGGTGTAAAACATTTGAAGGATTTTCCAATTCTGCCAGGAGAAATATTCAAATATA<br>AATGGACAGTGACTGTAGAAGATGGGCCAACTAAATCAGATCCTCGGTGCCTGACCCGCTATTACTCTAGTTTCGTTAAT<br>ATGGAGAGAGATCTAGCTTCAGGACTCATTGGCCCTCTCCTCATCTGCTACAAAGAATCTGTAGATCAAAGAGGAAACC<br>AGATAATGTCAGACAAGAGGAATGTCATCCTGTTTTCTGTATTTGATGAGAACCGAAGCTGGTACCTCACAGAGAATAT<br>ACAACGCTTTCTCCCCAATCCAGCTGGAGTGCAGCTTGAGGATCCAGAGTTCCAAGCCTCCAACATCATGCACAGCATCA<br>ATGGCTATGTTTTTGATAGTTTGCAGTTGTCAGTTTGTTTGCATGAGGTGGCATACTGGTACATTCTAAGCATTGGAGCA<br>CAGACTGACTTCCTTTCTGTCTTCTTCTCTGGATATACCTTCAAACACAAAATGGTCTATGAAGACACACTCACCCTATTCC<br>CATTCTCAGGAGAAACTGTCTTCATGTCGATGGAAAACCCAGGTCTATGGATTCTGGGGTGCCACAACTCAGACTTTCG<br>GAACAGAGGCATGACCGCCTTACTGAAGGTTTCTAGTTGTGACAAGAACACTGGTGATTATTACGAGGACAGTTATGAA<br>GATATTTCAGCATACTTGCTGAGTAAAAACAATGCCATTGAACCAAGAAGCTTCTCCCAGAATTCAAGACACCCTAGCAC<br>TAGGCAAAAGCAATTTAATGCCACCACAATTCCAGAAAATGACATAGAGAAGACTGACCCTTGGTTTGCACACAGAACA<br>CCTATGCCTAAAATACAAAATGTCTCCTCTAGTGATTTGTTGATGCTCTTGCGACAGAGTCCTACTCCACATGGGCTATCC<br>TTATCTGATCTCCAAGAAGCCAAATATGAGACTTTTTCTGATGATCCATCACCTGGAGCAATAGACAGTAATAACAGCCT<br>GTCTGAAATGACACACTTCAGGCCACAGCTCCATCACAGTGGGGACATGGTATTTACCCCTGAGTCAGGCCTCCAATTAA<br>GATTAAATGAGAAACTGGGGACAACTGCAGCAACAGAGTTGAAGAAACTTGATTTCAAAGTTTCTAGTACATCAAATAA<br>TCTGATTTCAACAATTCCATCAGACAATTTGGCAGCAGGTACTGATAATACAAGTTCCTTAGGACCCCCAAGTATGCCAG<br>TTCATTATGATAGTCAATTAGATACCACTCTATTTGGCAAAAAGTCATCTCCCCTTACTGAGTCTGGTGGACCTCTGAGCT<br>TGAGTGAAGAAAATAATGATTCAAAGTTGTTAGAATCAGGTTTAATGAATAGCCAAGAAAGTTCATGGGGAAAAAATG<br>TATCGTCAACAGAGAGTGGTAGGTTATTTAAAGGGAAAAGAGCTCATGGACCTGCTTTGTTGACTAAAGATAATGCCTT<br>ATTCAAAGTTAGCATCTCTTTGTTAAAGACAAACAAAACTTCCAATAATTCAGCAACTAATAGAAAGACTCACATTGATG<br>GCCCATCATTATTAATTGAGAATAGTCCATCAGTCTGGCAAAATATATTAGAAAGTGACACTGAGTTTAAAAAAGTGACA<br>CCTTTGATTCATGACAGAATGCTTATGGACAAAAATGCTACAGCTTTGAGGCTAAATCATATGTCAAATAAAACTACTTC<br>ATCAAAAAACATGGAAATGGTCCAACAGAAAAAAGAGGGCCCCATTCCACCAGATGCACAAAATCCAGATATGTCGTTC<br>TTTAAGATGCTATTCTTGCCAGAATCAGCAAGGTGGATACAAAGGACTCATGGAAAGAACTCTCTGAACTCTGGGCAAG<br>GCCCCAGTCCAAAGCAATTAGTATCCTTAGGACCAGAAAAATCTGTGGAAGGTCAGAATTTCTTGTCTGAGAAAAACAA<br>AGTGGTAGTAGGAAAGGGTGAATTTACAAAGGACGTAGGACTCAAAGAGATGGTTTTTCCAAGCAGCAGAAACCTATT<br>TCTTACTAACTTGGATAATTTACATGAAAATAATACACACAATCAAGAAAAAAAAATTCAGGAAGAAATAGAAAAGAAG<br>GAAACATTAATCCAAGAGAATGTAGTTTTGCCTCAGATACATACAGTGACTGGCACTAAGAATTTCATGAAGAACCTTTT<br>CTTACTGAGCACTAGGCAAAATGTAGAAGGTTCATATGACGGGGCATATGCTCCAGTACTTCAAGATTTTAGGTCATTAA<br>ATGATTCAACAAATAGAACAAAGAAACACACAGCTCATTTCTCAAAAAAAGGGGAGGAAGAAAACTTGGAAGGCTGG<br>GAAATCAAACCAAGCAAATTGTAGAGAAATATGCATGCACCACAAGGATATCTCCTAATACAAGCCAGCAGAATTTTGT<br>CACGCAACGTAGTAAGAGAGCTTTGAAACAATTCAGACTCCCACTAGAAGAAACAGAACTTGAAAAAAGGATAATTGT<br>GGATGACACCTCAACCCAGTGGTCCAAAAACATGAAACATTTGACCCCGAGCACCCTCACACAGATAGACTACAATGAG<br>AAGGAGAAAGGGGCCATTACTCAGTCTCCCTTATCAGATTGCCTTACGAGGAGTCATAGCATCCCTCAAGCAAATAGAT<br>CTCCATTACCCATTGCAAAGGTATCATCATTTCCATCTATTAGACCTATATATCTGACCAGGGTCCTATTCCAAGACAACT<br>CTTCTCATCTTCCAGCAGCATCTTATAGAAAGAAAGATTCTGGGGTCCAAGAAAGCAGTCATTTCTTACAAGGAGCCAAA<br>AAAAATAACCTTTCTTTAGCCATTCTAACCTTGGAGATGACTGGTGATCAAAGAGAGGTTGGCTCCCTGGGGACAAGTG<br>CCACAAATTCAGTCACATACAAGAAAGTTGAGAACACTGTTCTCCCGAAACCAGACTTGCCCAAAACATCTGGCAAAGTT |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | GAATTGCTTCCAAAAGTTCACATTTATCAGAAGGACCTATTCCCTACGGAAACTAGCAATGGGTCTCCTGGCCATCTGGA TCTCGTGGAAGGGAGCCTTCTTCAGGGAACAGAGGGAGCGATTAAGTGGAATGAAGCAAACAGACCTGGAAAAGTTC CCTTTCTGAGAGTAGCAACAGAAAGCTCTGCAAAGACTCCCTCCAAGCTATTGGATCCTCTTGCTGGGATAACCACTAT GGTACTCAGATACCAAAAGAAGAGTGGAAATCCCAAGAGAAGTCACCAGAAAAAACAGCTTTTAAGAAAAAGGATACC ATTTTGTCCCTGAACGCTTGTGAAAGCAATCATGCAATAGCAGCAATAAATGAGGGACAAAATAAGCCCGAAATAGAA GTCACCTGGGCAAAGCAAGGTAGGACTGAAAGGCTGTGCTCTCAAAACCCACCAGTCTTGAAACGCCATCAACGGGAA ATAACTCGTACTACTCTTCAGTCAGATCAAGAGGAAATTGACTATGATGATACCATATCAGTTGAAATGAAGAAGGAAG ATTTTGACATTTATGATGAGGATGAAAATCAGAGCCCCCGCAGCTTTCAAAAGAAAACACGACACTATTTTATTGCTGCA GTGGAGAGGCTCTGGGATTATGGGATGAGTAGCTCCCCACATGTTCTAAGAAACAGGGCTCAGAGTGGCAGTGTCCCT CAGTTCAAGAAAGTTGTTTTCCAGGAATTTACTGATGGCTCCTTTACTCAGCCCTTATACCGTGGAGAACTAAATGAACA TTTGGGACTCCTGGGGCCATATATAAGAGCAGAAGTTGAAGATAATATCATGGTAACTTTCAGAAATCAGGCCTCTCGT CCCTATTCCTTCTATTCTAGCCTTATTTCTTATGAGGAAGATCAGAGGCAAGGAGCAGAACCTAGAAAAAACTTTGTCAA GCCTAATGAAACCAAAACTTACTTTTGGAAAGTGCAACATCATATGGCACCCACTAAAGATGAGTTTGACTGCAAAGCCT GGGCTTATTTCTCTGATGTTGACCTGGAAAAAGATGTGCACTCAGGCCTGATTGGACCCCTTCTGGTCTGCCACACTAAC ACACTGAACCCTGCTCATGGGAGACAAGTGACAGTACAGGAATTTGCTCTGTTTTTCACCATCTTTGATGAGACCAAAAG CTGGTACTTCACTGAAAATATGGAAAGAAACTGCAGGGCTCCCTGCAATATCCAGATGGAAGATCCCACTTTTAAAGAG AATTATCGCTTCCATGCAATCAATGGCTACATAATGGATACACTACCTGGCTTAGTAATGGCTCAGGATCAAAGGATTCG ATGGTATCTGCTCAGCATGGGCAGCAATGAAAACATCCATTCTATTCATTTCAGTGGACATGTGTTCACTGTACGAAAAA AAGAGGAGTATAAAATGGCACTGTACAATCTCTATCCAGGTGTTTTTGAGACAGTGGAAATGTTACCATCCAAAGCTGG AATTTGGCGGGTGGAATGCCTTATTGGCGAGCATCTACATGCTGGGATGAGCACACTTTTTCTGGTGTACAGCAATAAG TGTCAGACTCCCCTGGGAATGGCTTCTGGACACATTAGAGATTTTCAGATTACAGCTTCAGGACAATATGGACAGTGGG CCCCAAAGCTGGCCAGACTTCATTATTCCGGATCAATCAATGCCTGGAGCACCAAGGAGCCCTTTTCTTGGATCAAGGTG GATCTGTTGGCACCAATGATTATTCACGGCATCAAGACCCAGGGTGCCCGTCAGAAGTTCTCCAGCCTCTACATCTCTCA GTTTATCATCATGTATAGTCTTGATGGGAAGAAGTGGCAGACTTATCGAGGAAATTCCACTGGAACCTTAATGGTCTTCT TTGGCAATGTGGATTCATCTGGGATAAAACACAATATTTTTAACCCTCCAATTATTGCTCGATACATCCGTTTGCACCCAA CTCATTATAGCATTCGCAGCACTCTTCGCATGGAGTTGATGGGCTGTGATTTAAATAGTTGCAGCATGCCATTGGGAATG GAGAGTAAAGCAATATCAGATGCACAGATTACTGCTTCATCCTACTTTACCAATATGTTTGCCACCTGGTCTCCTTCAAAA GCTCGACTTCACCTCCAAGGGAGGAGTAATGCCTGGAGACCTCAGGTGAATAATCCAAAAGAGTGGCTGCAAGTGGAC TTCCAGAAGACAATGAAAGTCACAGGAGTAACTACTCAGGGAGTAAAATCTCTGCTTACCAGCATGTATGTGAAGGAGT TCCTCATCTCCAGCAGTCAAGATGGCCATCAGTGGACTCTCTTTTTTCAGAATGGCAAAGTAAAGGTTTTTCAGGGAAAT CAAGACTCCTTCACACCTGTGGTGAACTCTCTAGACCCACCGTTACTGACTCGCTACCTTCGAATTCACCCCCAGAGTTGG GTGCACCAGATTGCCCTGAGGATGGAGGTTCTGGGCTGCGAGGCACAGGACCTCTACTGA |
| B domain-deleted (BDD) hEVIII with SQ sequence, 6 N-linked glycosylation sites, and furin cleavage site (SFSQNATNVSNNSNT SNDSNVSPPVLKRHQR) | 4425 | https://www.ncbi.nlm.nih.gov/pubmed/23426947 | 3 | 384 | ATGCAGATTGAGCTGAGCACCTGCTTCTTCCTGTGCCTGCTGAGGTTCTGCTTCTCTGCCACCAGGAGATACTACCTGGG GGCTGTGGAGCTGAGCTGGGACTACATGCAGTCTGACCTGGGGGAGCTGCCTGTGGATGCCAGGTTCCCCCCCAGAGT GCCCAAGAGCTTCCCCTTCAACACCTCTGTGGTGTACAAGAAGACCCTGTTTGTGGAGTTCACTGACCACCTGTTCAACA TTGCCAAGCCCAGGCCCCCCTGGATGGGCCTGCTGGGCCCCACCATCCAGGCTGAGGTGTATGACACTGTGGTGATCAC CCTGAAGAACATGGCCAGCCACCCTGTGAGCCTGCATGCTGTGGGGGTGAGCTACTGGAAGGCCTCTGAGGGGGCTGA GTATGATGACCAGACCAGCCAGAGGGAGAAGGAGGATGACAAGGTGTTCCCTGGGGGCAGCCACACCTATGTGTGGC AGGTGCTGAAGGAGAATGGCCCCATGGCCTCTGACCCCCTGTGCCTGACCTACAGCTACCTGAGCCATGTGGACCTGGT GAAGGACCTGAACTCTGGCCTGATTGGGGCCCTGCTGGTGTGCAGGGAGGGCAGCCTGGCCAAGGAGAAGACCCAGA CCCTGCACAAGTTCATCCTGCTGTTTGCTGTGTTTGATGAGGGCAAGAGCTGGCACTCTGAAACCAAGAACAGCCTGAT GCAGGACAGGGATGCTGCCTCTGCCAGGGCCTGGCCCAAGATGCACACTGTGAATGGCTATGTGAACAGGAGCCTGCC TGGCCTGATTGGCTGCCACAGGAAGTCTGTGTACTGGCATGTGATTGGCATGGGCACCACCCCTGAGGTGCACAGCATC TTCCTGGAGGGCCACACCTTCCTGGTCAGGAACCACAGGCAGGCCAGCCTGGAGATCAGCCCCATCACCTTCCTGACTG CCCAGACCCTGCTGATGGACCTGGGCCAGTTCCTGCTGTTCTGCCACATCAGCAGCCACCAGCATGATGGCATGGAGGC |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | CTATGTGAAGGTGGACAGCTGCCCTGAGGAGCCCCAGCTGAGGATGAAGAACAATGAGGAGGCTGAGGACTATGATG |
| | | | | | ATGACCTGACTGACTCTGAGATGGATGTGGTGAGGTTTGATGATGACAACAGCCCCAGCTTCATCCAGATCAGGTCTGT |
| | | | | | GGCCAAGAAGCACCCCAAGACCTGGGTGCACTACATTGCTGCTGAGGAGGAGGACTGGGACTATGCCCCCCTGGTGCT |
| | | | | | GGCCCCTGATGACAGGAGCTACAAGAGCCAGTACCTGAACAATGGCCCCCAGAGGATTGGCAGGAAGTACAAGAAGG |
| | | | | | TCAGGTTCATGGCCTACACTGATGAAACCTTCAAGACCAGGGAGGCCATCCAGCATGAGTCTGGCATCCTGGGCCCCCT |
| | | | | | GCTGTATGGGGAGGTGGGGGACACCCTGCTGATCATCTTCAAGAACCAGGCCAGCAGGCCCTACAACATCTACCCCCAT |
| | | | | | GGCATCACTGATGTGAGGCCCCTGTACAGCAGGAGGCTGCCCAAGGGGGTGAAGCACCTGAAGGACTTCCCCATCCTG |
| | | | | | CCTGGGGAGATCTTCAAGTACAAGTGGACTGTGACTGTGGAGGATGGCCCCACCAAGTCTGACCCCAGGTGCCTGACC |
| | | | | | AGATACTACAGCAGCTTTGTGAACATGGAGAGGGACCTGGCCTCTGGCCTGATTGGCCCCCTGCTGATCTGCTACAAGG |
| | | | | | AGTCTGTGGACCAGAGGGGCAACCAGATCATGTCTGACAAGAGGAATGTGATCCTGTTCTCTGTGTTTGATGAGAACA |
| | | | | | GGAGCTGGTACCTGACTGAGAACATCCAGAGGTTCCTGCCCAACCCTGCTGGGGTGCAGCTGGAGGACCCTGAGTTCC |
| | | | | | AGGCCAGCAACATCATGCACAGCATCAATGGCTATGTGTTTGACAGCCTGCAGCTGTCTGTGTGCCTGCATGAGGTGGC |
| | | | | | CTACTGGTACATCCTGAGCATTGGGGCCCAGACTGACTTCCTGTCTGTGTTCTTCTCTGGCTACACCTTCAAGCACAAGAT |
| | | | | | GGTGTATGAGGACACCCTGACCCTGTTCCCCTTCTCTGGGGAGACTGTGTTCATGAGCATGGAGAACCCTGGCCTGTGG |
| | | | | | ATTCTGGGCTGCCACAACTCTGACTTCAGGAACAGGGGCATGACTGCCCTGCTGAAAGTCTCCAGCTGTGACAAGAACA |
| | | | | | CTGGGGACTACTATGAGGACAGCTATGAGGACATCTCTGCCTACCTGCTGAGCAAGAACAATGCCATTGAGCCCAGGA |
| | | | | | GCTTCAGCCAGAATGCCACTAATGTGTCTAACAACAGCAACACCAGCAATGACAGCAATGTGTCTCCCCCAGTGCTGAA |
| | | | | | GAGGCACCAGAGGGAGATCACCAGGACCACCCTGCAGTCTGACCAGGAGGAGATTGACTATGATGACACCATCTCTGT |
| | | | | | GGAGATGAAGAAGGAGGACTTTGACATCTACGACGAGGACGAGAACCAGAGCCCCAGGAGCTTCCAGAAGAAGACCA |
| | | | | | GGCACTACTTCATTGCTGCTGTGGAGAGGCTGTGGGACTATGGCATGAGCAGCAGCCCCCATGTGCTGAGGAACAGGG |
| | | | | | CCCAGTCTGGCTCTGTGCCCCAGTTCAAGAAGGTGGTGTTCCAGGAGTTCACTGATGGCAGCTTCACCCAGCCCCTGTAC |
| | | | | | AGAGGGGAGCTGAATGAGCACCTGGGCCTGCTGGGCCCCTACATCAGGGCTGAGGTGGAGGACAACATCATGGTGAC |
| | | | | | CTTCAGGAACCAGGCCAGCAGGCCCTACAGCTTCTACAGCAGCCTGATCAGCTATGAGGAGGACCAGAGGCAGGGGGC |
| | | | | | TGAGCCCAGGAAGAACTTTGTGAAGCCCAATGAAACCAAGACCTACTTCTGGAAGGTGCAGCACCACATGGCCCCCACC |
| | | | | | AAGGATGAGTTTGACTGCAAGGCCTGGGCCTACTTCTCTGATGTGGACCTGGAGAAGGATGTGCACTCTGGCCTGATTG |
| | | | | | GCCCCCTGCTGGTGTGCCACACCAACACCCTGAACCCTGCCCATGGCAGGCAGGTGACTGTGCAGGAGTTTGCCCTGTT |
| | | | | | CTTCACCATCTTTGATGAAACCAAGAGCTGGTACTTCACTGAGAACATGGAGAGGAACTGCAGGGCCCCCTGCAACATC |
| | | | | | CAGATGGAGGACCCCACCTTCAAGGAGAACTACAGGTTCCATGCCATCAATGGCTACATCATGGACACCCTGCCTGGCC |
| | | | | | TGGTGATGGCCCAGGACCAGAGGATCAGGTGGTACCTGCTGAGCATGGGCAGCAATGAGAACATCCACAGCATCCACT |
| | | | | | TCTCTGGCCATGTGTTCACTGTGAGGAAGAAGGAGGAGTACAAGATGGCCCTGTACAACCTGTACCCTGGGGTGTTTGA |
| | | | | | GACTGTGGAGATGCTGCCCAGCAAGGCTGGCATCTGGAGGGTGGAGTGCCTGATTGGGGAGCACCTGCATGCTGGCA |
| | | | | | TGAGCACCCTGTTCCTGGTGTACAGCAACAAGTGCCAGACCCCCCTGGGCATGGCCTCTGGCCACATCAGGGACTTCCA |
| | | | | | GATCACTGCCTCTGGCCAGTATGGCCAGTGGGCCCCCAAGCTGGCCAGGCTGCACTACTCTGGCAGCATCAATGCCTGG |
| | | | | | AGCACCAAGGAGCCCTTCAGCTGGATCAAGGTGGACCTGCTGGCCCCCATGATCATCCATGGCATCAAGACCCAGGGG |
| | | | | | GCCAGGCAGAAGTTCAGCAGCCTGTACATCAGCCAGTTCATCATCATGTACAGCCTGGATGGCAAGAAGTGGCAGACCT |
| | | | | | ACAGGGGCAACAGCACTGGCACCCTGATGGTGTTCTTTGGCAATGTGGACAGCTCTGGCATCAAGCACAACATCTTCAA |
| | | | | | CCCCCCCATCATTGCCAGATACATCAGGCTGCACCCCACCCACTACAGCATCAGGAGCACCCTGAGGATGGAGCTGATG |
| | | | | | GGCTGTGACCTGAACAGCTGCAGCATGCCCCTGGGCATGGAGAGCAAGGCCATCTCTGATGCCCAGATCACTGCCAGC |
| | | | | | AGCTACTTCACCAACATGTTTGCCACCTGGAGCCCCAGCAAGGCCAGGCTGCACCTGCAGGGCAGGAGCAATGCCTGG |
| | | | | | AGGCCCCAGGTCAACAACCCCAAGGAG-MGCTGCAGGTGGACTTCCAGAAGACCATGAAGGTGACTGGGGTGACCAC |
| | | | | | CCAGGGGGTGAAGAGCCTGCTGACCAGCATGTATGTGAAGGAGTTCCTGATCAGCAGCAGCCAGGATGGCCACCAGTG |
| | | | | | GACCCTGTTCTTCCAGAATGGCAAGGTGAAGGTGTTCCAGGGCAACCAGGACAGCTTCACCCCTGTGGTGAACAGCCTG |
| | | | | | GACCCCCCCCTGCTGACCAGATACCTGAGGATTCACCCCCAGAGCTGGGTGCACCAGATTGCCCTGAGGATGGAGGTGC |
| | | | | | TGGGCTGTGAGGCCCAGGACCTGTACTGA |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| B domain-deleted (BDD) hFVIII with SQ sequence, 6 N-linked glycosylation sites, and furin cleavage site-amino acid sequence | | | | 385 | MQIELSTCFFLCLLRFCFSATRRYYLGAVELSWDYMQSDLGELPVDARFPPRVPKSFPFNTSVVYKKTLFVEFTDHLFNIAKPRP PWMGLLGPTIQAEVYDTVVITLKNMASHPVSLHAVGVSYWKASEGAEYDDQTSQREKEDDKVFPGGSHTYVWQVLKENG PMASDPLCLTYSYLSHVDLVKDLNSGLIGALLVCREGSLAKEKTQTLHKFILLFAVFDEGKSWHSETKNSLMQDRDAASARAW PKMHTVNGYVNRSLPGLIGCHRKSVYWHVIGMGTTPEVHSIFLEGHTFLVRNHRQASLEISPITFLTAQTLLMDLGQFLLFCHI SSHQHDGMEAYVKVDSCPEEPQLRMKNNEEAEDYDDDLTDSEMDVVRFDDDNSPSFIQIRSVAKKHPKTWVHYIAAEEED WDYAPLVLAPDDRSYKSQYLNNGPQRIGRKYKKVRFMAYTDETFKTREAIQHESGILGPLLYGEVGDTLLIIFKNQASRPYNIYP HGITDVRPLYSRRLPKGVKHLKDFPILPGEIFKYKWTVTVEDGPTKSDPRCLTRYYSSFVNMERDLASGLIGPLLICYKESVDQR GNQIMSDKRNVILFSVFDENRSWYLTENIQRFLPNPAGVQLEDPEFQASNIMHSINGYVFDSLQLSVCLHEVAYWYILSIGAQ TDFLSVFFSGYTFKHKMVYEDTLTLFPFSGETVFMSMENPGLWILGCHNSDFRNRGMTALLKVSSCDKNTGDYYEDSYEDISA YLLSKNNAIEPRSFSQNATNVSNNSNTSNDSNVSPPVLKRHQREITRTTLQSDQEEIDYDDTISVEMKKEDFDIYDEDENQSPR SFQKKTRHYFIAAVERLWDYGMSSSPHVLRNRAQSGSVPQFKKVVFQEFTDGSFTQPLYRGELNEHLGLLGPYIRAEVEDNI MVTFRNQASRPYSFYSSLISYEEDQRQGAEPRKNFVKPNETKTYFWKVQHHMAPTKDEFDCKAWAYFSDVDLEKDVHSGLI GPLLVCHTNTLNPANGRQVTVQEFALFFTIFDETKSWYFTENMERNCRAPCNIQMEDPTFKENYRFHAINGYIMDTLPGLV MAQDQRIRWYLLSMGSNENIHSIHFSGHVFTVRKKEEYKMALYNLYPGVFETVEMLPSKAGIWRVECLIGEHLHAGMSTLFL VYSNKCQTPLGMASGHIRDFQITASGQYGQWAPKLARLHYSGSINAWSTKEPFSWIKVDLLAPMIIHGIKTQGARQKFSSLYI SQFIIMYSLDGKKWQTYRGNSTGTLMVFFGNVDSSGIKHNIFNPPIIARYIRLHPTHYSIRSTLRMELMGCDLNSCSMPLGME SKAISDAQITASSYFTNMFATWSPSKARLHLQGRSNAWRPQVNNPKEWLQVDFQKTMKVTGVTTQGVKSLLTSMYVKEELI SSSQDGHQWTLFFQNGKVKVFQGNQDSFTPVVNSLDPPLLTRYLRIHPQSWVHQIALRMEVLGCEAQDLY- |
| B domain-deleted (BDD) hFVIII with SQ sequence fused to Fc region | 5055 | US 9,050,318 B2 | 92 | 386 | atgcaaatagagctctccacctgcttctttctgtgattttgcgattctgctttagtgccaccagaagatactacctgggtgcagtggaact gtcatgggactatatgcaaagtgatctcggtgagctgcctgtggacgcaagatttcctcctagagtgccaaaatcttttccattcaacacc tcagtcgtgtacaaaaagactctgtttgtagaattcacggatcacatttcaacatcgctaagccaaggccaccctggatgggtctgctagg tcctaccatccaggctgaggtttatgatacagtggtcattacacttaagaacatggcttcccatcctgtcagtcttcatgctgttggtgta tcctactggaaagcttctgagggagctgaatatgatgatcagaccagtcaaagggagaaagaagatgataaagtcttccctggtggaagc catacatatgtctggcaggtcctgaaagagaatggtccaatggcctctgacccactgtgccttacctactcatatctttctcatgtggacc tggtaaaagacttgaattcaggcctcattggagccctactagtatgtagagaagggagtctggccaaggaaaagacacagaccttgcac aaatttatactacttttttgctgtatttgatgaagggaaaagttggcactcagaaacaaagaactccttgatgcaggatagggatgctgcat ctgctcgggcctggcctaaaatgcacacagtcaatggttatgtaaacaggtctctgccaggtctgattggatgccacaggaaatcagtcta ttggcatgtgattggaatgggcaccactcctgaagtgcactcaatattcctcgaaggtcacacatttcttgtgaggaaccatcgccaggcg tccttggaaatctcgccaataactttccttactgctcaaacactcttgatggaccttggacagtttctactgttttgtcatatctcttccc accaacatgatggcatggaagcttatgtcaaagtagacagctgtccagaggaaccccaactacgaatgaaaaataatgaagaagcggaaga ctatgatgatgatcttactgattctgaaatggatgtggtcaggtttgatgatgacaactctccttcctttatccaaattcgctcagttgcc aagaagcatcctaaaacttgggtacattacattgctgctgaagaggaggactgggactatgctcccttagtcctcgcccccgatgacaga agttataaaagtcaatatttgaacaatggccctcagcggattggtaggaagtacaaaaaagtccgatttatggcatacacagatgaaacc tttaagactcgtgaagctattcagcatgaatcaggaatcttgggacctttactttatggggaagttggagacacactgttgattatattt aagaatcaagcaagcagaccatataacatctaccctcacggaatcactgatgtccgtcctttgtattcaaggagattaccaaaaggtgtaa aacatttgaaggattttccaattctgccaggagaaatattcaaatataaatggacagtgactgtagaagatgggccaactaaatcagatc ctcggtgcctgacccgctattactctagtttcgttaatatggagagagatctagcttcaggactcattggccctctcctcatctgctaca aagaatctgtagatcaaagaggaaaccagataatgtcagacaagaggaatgtcatcctgttttctgtatttgatgagaaccgaagctggt acctcacagagaatatacaacgctttctccccaatccagctggagtgcagcttgaggatccagagttccaagcctccaacatcatgcaca gcatcaatggctatgtttttgatagtttgcagttgtcagtttgtttgcatgaggtggcatactggtacattctaagcattggagcacaga ctgacttcctttctgtcttcttctctggatataccttcaaacacaaaatggtctatgaagacacactcaccctattcccattctcaggag aaactgtcttcatgtcgatggaaaacccaggtctatggattctggggtgccacaactcagactttcggaacagaggcatgaccgccttact gaaggtttctagttgtgacaagaacactggtgattattacgaggacagttatgaagatatttcagcatacttgctgagtaaaaacaatgc cattgaaccaagaagcttctctcaaaacccaccagtcttgaaacgccatcaacgggaaataactcgtactactcttcagtcagatcaagag |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | gaaattgactatgatgataccatatcagttgaaatgaagaaggaagattttgacatttatgatgaggatgaaaatcagagcccccgcagct<br>ttcaaaagaaaacacgacactattttattgctgcagtggagaggctctgggattatgggatgagtagctccccacatgttctaagaaacag<br>ggctcagagtggcagtgtccctcagttcaagaaagttgttttccaggaatttactgatggctcctttactcagcccttataccgtggagaa<br>ctaaatgaacatttgggactcctggggccatatataagagcagaagttgaagataatatcatggtaactttcagaaatcaggcctctcgt<br>ccctattccttctattctagccttatttcttatgaggaagatcagaggcaaggagcagaacctagaaaaaactttgtcaagcctaatgaaa<br>ccaaaacttacttttggaaagtgcaacatcatatggcacccactaaagatgagtttgactgcaaagcctgggcttatttctctgatgttga<br>cctggaaaaagatgtgcactcaggcctgattggaccccttctggtctgccacactaacacactgaaccctgctcatgggagacaagtgaca<br>gtacaggaatttgctctgtttttcaccatctttgatgagaccaaaagctggtacttcactgaaaatatggaaagaaactgcagggctccct<br>gcaatatccagatggaagatcccactttaaagagaattatcgcttccatgcaatcaatggctacataatggatacactacctggcttag<br>taatggctcaggatcaaaggattcgatggtatctgctcagcatgggcagcaatgaaaacatccattctattcatttcagtggacatgtgtt<br>cactgtacgaaaaaaagaggagtataaaatggcactgtacaatctctatccaggtgtttttgagacagtggaaatgttaccatccaaagc<br>tggaatttggcgggtggaatgccttattggcgagcatctacatgctgggatgagcacacttttctggtgtacagcaataagtgtcagac<br>tcccctgggaatggcttctggacacattagagattttcagattacagcttcaggacaatatggacagtgggccccaaagctggccagact<br>tcattattccggatcaatcaatgcctggagcaccaaggagcccttttcttggatcaaggtggatctgttggcaccaatgattattcacggc<br>atcaagacccagggtgcccgtcagaagttctccagcctctacatctctcagtttatcatcatgtatagtcttgatgggaagaagtggcag<br>acttatcgaggaaattccactggaaccttaatggtcttctttggcaatgtggattcatctgggataaaacacaatattttaaccctcca<br>attattgctcgatacatccgtttgcacccaactcattatagcattcgcagcactcttcgcatggagttgatgggctgtgatttaaatagt<br>tgcagcatgccattgggaatggagagtaaagcaatatcagatgcacagattactgcttcatcctactttaccaatatgtttgccacctgg<br>tctccttcaaaagctcgacttcacctccaagggaggagtaatgcctggagacctcaggtgaataatccaaaagagtggctgcaagtggact<br>tccagaagacaatgaaagtcacaggagtaactactcagggagtaaaatctctgcttaccagcatgtatgtgaaggagttcctcatctcca<br>gcagtcaagatggccatcagtggactctctttttcagaatggcaaagtaaaggtttttcagggaaatcaagactccttcacacctgtgg<br>tgaactctctagacccaccgttactgactcgctaccttcgaattcaccccccagagttgggtgcaccagattgccctgaggatggaggttct<br>gggctgcgaggcacaggacctctacgacaaaactcacacatgcccaccgtgcccagctccagaactcctgggcggaccgtcagtcttcctc<br>ttccccccaaaacccaaggacaccctcatgatctcccggacccctgaggtcacatgcgtggtggtggacgtgagccacgaagaccctgagg<br>tcaagttcaactggtacgtggacggcgtggaggtgcataatgccaagacaaagccgcgggaggagcagtacaacagcacgtaccgtgtgg<br>tcagcgtcctcaccgtcctgcaccaggactggctgaatggcaaggagtacaagtgcaaggtctccaacaaagccctcccagcccccatcga<br>gaaaaccatctccaaagccaaagggcagccccgagaaccacaggtgtacaccctgcccccatcccgggatgagctgaccaagaaccaggtc<br>agcctgacctgcctggtcaaaggcttctatcccagcgacatcgccgtggagtgggagagcaatgggcagccggagaacaactacaagacca<br>cgcctcccgtgttggactccgacggctccttcttcctctacagcaagctcaccgtggacaagagcaggtggcagcaggggaacgtcttctc<br>atgctccgtgatgcatgaggctctgcacaaccactacacgcagaagagcctctccctgtctccgggtaaa |
| B domain-deleted (BDD) hEVIII with SQ sequence (codop) | 4374 | | 211 | 387 | ATGCAGATCGAGCTGTCTACCTGCTTCTTCCTGTGCCTGCTGCGGTTCTGCTTCAGCGCCACCAGAAGATATTACCTGGG<br>CGCCGTGGAACTGAGCTGGGACTACATGCAGTCTGACCTGGGAGAGCTGCCCGTGGACGCTAGATTTCCTCCAAGAGT<br>GCCCAAGAGCTTCCCCTTCAACACCTCCGTGGTGTACAAGAAAACCCTGTTCGTGGAATTCACCGACCACCTGTTCAATA<br>TCGCCAAGCCTCGGCCTCCTTGGATGGGACTGCTGGGACCTACAATTCAGGCCGAGGTGTACGACACCGTGGTCATCAC<br>CCTGAAGAACATGGCCAGCCATCCTGTGTCTCTGCACGCCGTGGGAGTGTCTTATTGGAAGGCTTCTGAGGGCGCCGAG<br>TACGACGATCAGACAAGCCAGAGAGAGAAAGAGGACGACAAGGTTTTCCCTGGCGGCAGCCACACCTATGTCTGGCAG<br>GTCCTGAAAGAAAACGGCCCTATGGCCTCCGATCCTCTGTGCCTGACATACAGCTACCTGAGCCACGTGGACCTGGTCA<br>AGGACCTGAATTCTGGCCTGATCGGAGCCCTGCTCGTGTGTAGAGAAGGCAGCCTGGCCAAAGAGAAAACCCAGACAC<br>TGCACAAGTTCATCCTGCTGTTCGCCGTGTTCGACGAGGGCAAGAGCTGGCACAGCGAGACAAAGAACAGCCTGATGC<br>AGGACAGGGATGCCGCCTCTGCTAGAGCTGGCCTAAGATGCACACCGTGAACGGCTACGTGAACAGAAGCCTGCCTG<br>GACTGATCGGCTGCCACAGAAAGTCCGTGTACTGGCACGTGATCGGCATGGGCACAACACCTGAGGTGCACAGCATCT<br>TTCTGGAAGGCCACACCTTCCTCGTGCGGAACCACAGACAGGCCAGCCTGGAAATCAGCCCTATCACCTTCCTGACCGCT<br>CAGACCCTGCTGATGGATCTGGGCCAGTTTCTGCTGTTCTGCCACATCAGCTCCCACCAGCACGATGGCATGGAAGCCT<br>ACGTGAAGGTGGACAGCTGCCCCGAAGAACCCCAGCTGCGGATGAAGAACAACGAGGAAGCCGAGGACTACGACGAC<br>GACCTGACCGACTCTGAGATGGACGTCGTCAGATTCGACGACGATAACAGCCCCAGCTTCATCCAGATCAGAAGCGTGG |

TABLE 1-continued

Exemplary FVIII sequences for treatment of hemophilia A
Exemplary nucleic acid sequences encoding Factor VIII

| Description | Length | Ref-erence | CG Content | SEQ ID NO: | Sequence |
|---|---|---|---|---|---|
| | | | | | CCAAGAAGCACCCCAAGACCTGGGTGCACTATATCGCCGCCGAGGAAGAGGACTGGGATTACGCTCCTCTGGTGCTGG |
| | | | | | CCCCTGACGACAGAAGCTACAAGAGCCAGTACCTGAACAACGGCCCTCAGCGGATCGGCCGGAAGTATAAGAAAGTGC |
| | | | | | GGTTCATGGCCTACACCGACGAGACATTCAAGACCAGAGAGGCCATCCAGCACGAGAGCGGAATTCTGGGCCCTCTGC |
| | | | | | TGTATGGCGAAGTGGGCGATACACTGCTGATCATCTTCAAGAACCAGGCCAGCAGACCCTACAACATCTACCCTCACGG |
| | | | | | CATCACCGATGTGCGGCCCCTGTATTCTAGAAGGCTGCCCAAGGGCGTGAAGCACCTGAAGGACTTCCCTATCCTGCCT |
| | | | | | GGCGAGATTTTCAAGTACAAGTGGACCGTGACCGTGGAAGATGGCCCCACCAAGAGCGACCCTAGATGTCTGACACGG |
| | | | | | TACTACAGCAGCTTCGTGAACATGGAACGCGACCTGGCCAGCGGCCTGATTGGACCTCTGCTGATCTGCTACAAAGAAA |
| | | | | | GCGTGGACCAGCGGGGCAACCAGATCATGAGCGACAAGCGGAACGTGATCCTGTTTAGCGTGTTCGATGAGAACCGGT |
| | | | | | CCTGGTATCTGACCGAGAACATCCAGCGGTTTCTGCCCAATCCTGCCGGGGTGCAACTGGAAGATCCTGAGTTCCAGGC |
| | | | | | AAGCAACATCATGCACTCCATCAATGGCTATGTGTTCGACAGCCTGCAGCTGAGCGTGTGCCTGCACGAAGTGGCCTAC |
| | | | | | TGGTACATCCTGAGCATTGGCGCCCAGACCGACTTCCTGTCCGTGTTCTTTAGCGGCTACACCTTCAAGCACAAGATGGT |
| | | | | | GTACGAGGATACCCTGACACTGTTCCCATTCAGCGGCGAGACAGTGTTCATGAGCATGGAAAACCCCGGCCTGTGGATT |
| | | | | | CTGGGCTGTCACAACAGCGACTTCCGGAACAGAGGCATGACAGCCCTGCTGAAGGTGTCCAGCTGCGACAAGAACACC |
| | | | | | GGCGACTACTACGAGGACAGCTATGAGGACATCAGCGCCTACCTGCTGAGCAAGAACAATGCCATCGAGCCTCGGAGC |
| | | | | | TTCAGCCAGAATCCTCCTGTGCTGAAGCGGCACCAGCGCGAGATCACCAGAACAACCCTGCAGAGCGACCAAGAGGAA |
| | | | | | ATCGATTACGACGACACCATCAGCGTCGAGATGAAGAAAGAAGATTTCGACATCTACGACGAGGACGAGAATCAGAGC |
| | | | | | CCCAGAAGCTTTCAGAAAAAGACCCGGCACTACTTCATTGCCGCCGTCGAGAGACTGTGGGACTACGGCATGTCTAGCA |
| | | | | | GCCCTCACGTGCTGAGAAATAGAGCCCAGAGCGGCAGCGTGCCCCAGTTCAAGAAAGTGGTGTTCCAAGAGTTCACCG |
| | | | | | ACGGCAGCTTCACCCAGCCACTGTATAGAGGCGAGCTGAACGAGCATCTGGGCCTGCTGGGCCCTTATATCAGAGCCG |
| | | | | | AAGTGGAAGATAACATCATGGTCACCTTCCGGAATCAGGCTAGCCGGCCTTACAGCTTCTACAGCTCCCTGATCAGCTAC |
| | | | | | GAAGAGGACCAGAGACAGGGCGCTGAGCCCAGAAAGAACTTCGTGAAGCCCAACGAGACTAAGACCTACTTTTGGAA |
| | | | | | GGTGCAGCACCACATGGCCCCTACAAAGGACGAGTTCGACTGCAAAGCCTGGGCCTACTTCTCCGATGTGGATCTGGAA |
| | | | | | AAGGACGTGCACAGCGGGCTCATCGGACCACTGCTTGTGTGCCACACCAACACACTGAACCCCGCTCACGGCAGACAA |
| | | | | | GTGACAGTGCAAGAGTTCGCCCTGTTCTTCACCATCTTCGACGAAACAAAGAGCTGGTACTTCACCGAGAATATGGAAC |
| | | | | | GGAACTGCAGAGCCCCTTGCAACATCCAGATGGAAGATCCCACCTTCAAAGAGAACTACCGGTTCCACGCCATCAACGG |
| | | | | | CTACATCATGGACACACTGCCCGGCCTGGTTATGGCCCAGGATCAGAGAATCCGGTGGTATCTGCTGTCCATGGGCTCC |
| | | | | | AACGAGAATATCCACAGCATCCACTTCAGCGGCCACGTGTTCACCGTGCGGAAAAAAGAAGAGTACAAAATGGCCCTG |
| | | | | | TACAATCTGTACCCTGGGGTGTTCGAAACCGTGGAAATGCTGCCTTCCAAGGCCGGCATTTGGAGAGTGGAATGTCTGA |
| | | | | | TTGGAGAGCACCTCCACGCCGGAATGAGCACCCTGTTTCTGGTGTACAGCAACAAGTGTCAGACCCCTCTCGGCATGGC |
| | | | | | CTCTGGACACATCAGAGACTTCCAGATCACCGCCTCTGGCCAGTACGGACAGTGGGCTCCTAAACTGGCTCGGCTGCAC |
| | | | | | TACAGCGGCAGCATCAATGCCTGGTCCACCAAAGAGCCCTTCAGCTGGATCAAGGTGGACCTGCTGGCTCCCATGATCA |
| | | | | | TCCACGGAATCAAGACCCAGGGCGCCAGACAGAAGTTCAGCAGCCTGTACATCAGCCAGTTCATCATCATGTACAGCCT |
| | | | | | GGACGGCAAGAAGTGGCAGACCTACAGAGGCAACAGCACCGGCACACTCATGGTGTTCTTCGGCAACGTGGACTCCAG |
| | | | | | CGGCATTAAGCACAACATCTTCAACCCTCCAATCATTGCCCGGTACATCCGGCTGCACCCCACACACTACAGCATCCGGT |
| | | | | | CTACCCTGAGAATGGAACTGATGGGCTGCGACCTGAACAGCTGCTCTATGCCCCTCGGAATGGAAAGCAAGGCCATCA |
| | | | | | GCGACGCCCAGATCACAGCCAGCAGCTACTTCACCAACATGTTCGCCACTTGGAGCCCCTCCAAGGCTAGACTGCATCT |
| | | | | | GCAGGGCAGAAGCAACGCTGGAGGCCCCAAGTGAACAACCCCAAAGAGTGGCTGCAGGTTGACTTTCAAAAGACCAT |
| | | | | | GAAAGTGACCGGCGTGACCACACAGGGCGTCAAGTCTCTGCTGACCTCTATGTACGTGAAAGAGTTCCTGATCTCCAGC |
| | | | | | AGCCAGGACGGCCATCAGTGGACCCTGTTTTTCCAGAACGGCAAAGTGAAAGTGTTCCAGGGCAATCAGGACAGCFTC |
| | | | | | ACACCCGTGGTCAATTCTCTGGACCCTCCACTGCTGACCAGATACCTGCGGATTCACCCTCAGTCTTGGGTGCACCAGAT |
| | | | | | CGCTCTGCGGATGGAAGTGCTGGGCTGTGAAGCTCAGGACCTCTACTAG |
| Jcat optimized B-domain truncated (206 amino acids | 4980 | | 350 | 388 | ATGCAGATCGAGCTGAGCACCTGCTTCTTCCTGTGCCTGCTGCGCTTCTGCTTCAGCGCCACCCGCCGCTACTACCTGGG |
| | | | | | CGCCGTGGAGCTGAGCTGGGACTACATGCAGAGCGACCTGGGCGAGCTGCCCGTGGACGCCCGCTTCCCCCCCCGCGT |
| | | | | | GCCCAAGAGCTTCCCCTTCAACACCAGCGTGGTGTACAAGAAGACCCTGTTCGTGGAGTTCACCGACCACCTGTTCAACA |
| | | | | | TCGCCAAGCCCCGCCCCCCCTGGATGGGCCTGCTGGGCCCCACCATCCAGGCCGAGGTGTACGACACCGTGGTGATCAC |

TABLE 1-continued

Exemplary FVIII sequences for treatment of hemophilia A
Exemplary nucleic acid sequences encoding Factor VIII

| Description | Length | Ref-erence | CG Content | SEQ ID NO: | Sequence |
|---|---|---|---|---|---|
| remaining) Human<br>Factor VIII<br>ORF (BDD-206) | | | | | CCTGAAGAACATGGCCAGCCACCCCGTGAGCCTGCACGCCGTGGGCGTGAGCTACTGGAAGGCCAGCGAGGGCGCCG<br>AGTACGACGACCAGACCAGCCAGCGCGAGAAGGAGGACGACAAGGTGTTCCCCGGCGGCAGCCACACCTACGTGTGG<br>CAGGTGCTGAAGGAGAACGGCCCCATGGCCAGCGACCCCCTGTGCCTGACCTACAGCTACCTGAGCCACGTGGACCTG<br>GTGAAGGACCTGAACAGCGGCCTGATCGGCGCCCTGCTGGTGTGCCGCGAGGGCAGCCTGGCCAAGGAGAAGACCCA<br>GACCCTGCACAAGTTCATCCTGCTGTTCGCCGTGTTCGACGAGGGCAAGAGCTGGCACAGCGAGACCAAGAACAGCCT<br>GATGCAGGACCGCGACGCCGCCAGCGCCCGCGCCTGGCCCAAGATGCACACCGTGAACGGCTACGTGAACCGCAGCCT<br>GCCCGGCCTGATCGGCTGCCACCGCAAGAGCGTGTACTGGCACGTGATCGGCATGGGCACCACCCCCGAGGTGCACAG<br>CATCTTCCTGGAGGGCCACACCTTCCTGGTGCGCAACCACCGCCAGGCCAGCCTGGAGATCAGCCCCATCACCTTCCTGA<br>CCGCCCAGACCCTGCTGATGGACCTGGGCCAGTTCCTGCTGTTCTGCCACATCAGCAGCCACCAGCACGACGGCATGGA<br>GGCCTACGTGAAGGTGGACAGCTGCCCCGAGGAGCCCCAGCTGCGCATGAAGAACAACGAGGAGGCCGAGGACTACG<br>ACGACGACCTGACCGACAGCGAGATGGACGTGGTGCGCTTCGACGACGACAACAGCCCCAGCTTCATCCAGATCCGCA<br>GCGTGGCCAAGAAGCACCCCAAGACCTGGGTGCACTACATCGCCGCCGAGGAGGAGGACTGGGACTACGCCCCCCTG<br>GTGCTGGCCCCCGACGACCGCAGCTACAAGAGCCAGTACCTGAACAACGGCCCCCAGCGCATCGGCCGCAAGTACAAG<br>AAGGTGCGCTTCATGGCCTACACCGACGAGACCTTCAAGACCCGCGAGGCCATCCAGCACGAGAGCGGCATCCTGGGC<br>CCCCTGCTGTACGGCGAGGTGGGCGACACCCTGCTGATCATCTTCAAGAACCAGGCCAGCCGCCCCTACAACATCTACC<br>CCCACGGCATCACCGACGTGCGCCCCCTGTACAGCCGCCGCCTGCCCAAGGGCGTGAAGCACCTGAAGGACTTCCCCAT<br>CCTGCCCGGCGAGATCTTCAAGTACAAGTGGACCGTGACCGTGGAGGACGGCCCCACCAAGAGCGACCCCCGCTGCCT<br>GACCCGCTACTACAGCAGCTTCGTGAACATGGAGCGCGACCTGGCCAGCGGCCTGATCGGCCCCCTGCTGATCTGCTAC<br>AAGGAGAGCGTGGACCAGCGCGGCAACCAGATCATGAGCGACAAGCGCAACGTGATCCTGTTCAGCGTGTTCGACGA<br>GAACCGCAGCTGGTACCTGACCGAGAACATCCAGCGCTTCCTGCCCAACCCCGCCGGCGTGCAGCTGGAGGACCCCGA<br>GTTCCAGGCCAGCAACATCATGCACAGCATCAACGGCTACGTGTTCGACAGCCTGCAGCTGAGCGTGTGCCTGCACGAG<br>GTGGCCTACTGGTACATCCTGAGCATCGGCGCCCAGACCGACTTCCTGAGCGTGTTCTTCAGCGGCTACACCTTCAAGCA<br>CAAGATGGTGTACGAGGACACCCTGACCCTGTTCCCCTTCAGCGGCGAGACCGTGTTCATGAGCATGGAGAACCCCGGC<br>CTGTGGATCCTGGGCTGCCACAACAGCGACTTCCGCAACCGCGGCATGACCGCCCTGCTGAAGGTGAGCAGCTGCGAC<br>AAGAACACCGGCGACTACTACGAGGACAGCTACGAGGACATCAGCGCCTACCTGCTGAGCAAGAACAACGCCATCGAG<br>CCCCGCAGCTTCAGCCAGAACAGCCGCCACCCCAGCACCCGCCAGAAGCAGTTCAACGCCACCACCATCCCCGAGAACG<br>ACATCGAGAAGACCGACCCCTGGTTCGCCCACCGCACCCCCATGCCCAAGATCCAGAACGTGAGCAGCAGCGACCTGCT<br>GATGCTGCTGCGCCAGAGCCCCACCCCCCACGGCCTGAGCCTGAGCGACCTGCAAGAGGCCAAGTACGAGACCTTCAG<br>CGACGACCCCAGCCCCGGCGCCATCGACAGCAACAACAGCCTGAGCGAGATGACCCACTTCCGCCCCCAGCTGCACCAC<br>AGCGGCGACATGGTGTTCACCCCCGAGAGCGGCCTGCAGCTGCGCCTGAACGAGAAGCTGGGCACCACCGCCGCCACC<br>GAGCTGAAGAAGCTGGACTTCAAGGTGAGCAGCACCAGCAACAACCTGATCAGCACCATCCCCAGCGACAACCTGGCC<br>GCCGGCACCGACAACACCAGCAGCCTGGGCCCCCCCAGCATGCCCGTGCACTACGACAGCCAGCTGGACACCACCCTGT<br>TCGGCAAGAAGAGCAGCCCCCTGACCGAGAGCGGCGGCCCCCTGAGCCTGAGCGAGGAGAACAACGACAGCAAGCTG<br>CCCCCCGTGCTGAAGCGCCACCAGCGCGAGATCACCCGCACCACCCTGCAGAGCGACCAGGAGGAGATCGACTACGAC<br>GACACCATCAGCGTGGAGATGAAGAAGGAGGACTTCGACATCTACGACGAGGACGAGAACCAGAGCCCCCGCAGCTT<br>CCAGAAGAAGACCCGCCACTACTTCATCGCCGCCGTGGAGCGCCTGTGGGACTACGGCATGAGCAGCAGCCCCCACGT<br>GCTGCGCAACCGCGCCCAGAGCGGCAGCGTGCCCCAGTTCAAGAAGGTGGTGTTCCAGGAGTTCACCGACGGCAGCTT<br>CACCCAGCCCCTGTACCGCGGCGAGCTGAACGAGCACCTGGGCCTGCTGGGCCCCTACATCCGCGCCGAGGTGGAGGA<br>CAACATCATGGTGACCTTCCGCAACCAGGCCAGCCGCCCCTACAGCTTCTACAGCAGCCTGATCAGCTACGAGGAGGAC<br>CAGCGCCAGGGCGCCGAGCCCCGCAAGAACTTCGTGAAGCCCAACGAGACCAAGACCTACTTCTGGAAGGTGCAGCAC<br>CACATGGCCCCCACCAAGGACGAGTTCGACTGCAAGGCCTGGGCCTACTTCAGCGACGTGGACCTGGAGAAGGACGTG<br>CACAGCGGCCTGATCGGCCCCCTGCTGGTGTGCCACACCAACACCCTGAACCCCGCCCACGGCCGCCAGGTGACCGTGC<br>AGGAGTTCGCCCTGTTCTTCACCATCTTCGACGAGACCAAGAGCTGGTACTTCACCGAGAACATGGAGCGCAACTGCCG<br>CGCCCCCTGCAACATCCAGATGGAGGACCCCACCTTCAAGGAGAACTACCGCTTCCACGCCATCAACGGCTACATCATG<br>GACACCCTGCCCGGCCTGGTGATGGCCCAGGACCAGCGCATCCGCTGGTACCTGCTGAGCATGGGCAGCAACGAGAAC<br>ATCCACAGCATCCACTTCAGCGGCCACGTGTTCACCGTGCGCAAGAAGGAGGAGTACAAGATGGCCCTGTACAACCTGT |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | ACCCCGGCGTGTTCGAGACCGTGGAGATGCTGCCCAGCAAGGCCGGCATCTGGCGCGTGGAGTGCCTGATCGGCGAG<br>CACCTGCACGCCGGCATGAGCACCCTGTTCCTGGTGTACAGCAACAAGTGCCAGACCCCCCTGGGCATGGCCAGCGGCC<br>ACATCCGCGACTTCCAGATCACCGCCAGCGGCCAGTACGGCCAGTGGGCCCCCAAGCTGGCCCGCCTGCACTACAGCG<br>GCAGCATCAACGCCTGGAGCACCAAGGAGCCCTTCAGCTGGATCAAGGTGGACCTGCTGGCCCCCATGATCATCCACG<br>GCATCAAGACCCAGGGCGCCCGCCAGAAGTTCAGCAGCCTGTACATCAGCCAGTTCATCATCATGTACAGCCTGGACGG<br>CAAGAAGTGGCAGACCTACCGCGGCAACAGCACCGGCACCCTGATGGTGTTCTTCGGCAACGTGGACAGCAGCGGCAT<br>CAAGCACAACATCTTCAACCCCCCCATCATCGCCCGCTACATCCGCCTGCACCCCACCCACTACAGCATCCGCAGCACCCT<br>GCGCATGGAGCTGATGGGCTGCGACCTGAACAGCTGCAGCATGCCCCTGGGCATGGAGAGCAAGGCCATCAGCGACG<br>CCCAGATCACCGCCAGCAGCTACTTCACCAACATGTTCGCCACCTGGAGCCCCAGCAAGGCCCGCCTGCACCTGCAAGG<br>CCGCAGCAACGCCTGGCGCCCCCAGGTGAACAACCCCAAGGAGTGGCTGCAGGTGGACTTCCAGAAGACCATGAAGGT<br>GACCGGCGTGACCACCCAGGGCGTGAAGAGCCTGCTGACCAGCATGTACGTGAAGGAGTTCCTGATCAGCAGCAGCCA<br>GGACGGCCACCAGTGGACCCTGTTCTTCCAGAACGGCAAGGTGAAGGTGTTCCAGGGCAACCAGGACAGCTTCACCCC<br>CGTGGTGAACAGCCTGGACCCCCCCCTGCTGACCCGCTACCTGCGCATCCACCCCCAGAGCTGGGTGCACCAGATCGCC<br>CTGCGCATGGAGGTGCTGGGCTGCGAGGCCCAGGACCTGTACTAA |
| Jcat optimized Wild type Human Factor VIII ORF | 7056 | | 467 | 389 | ATGCAGATCGAGCTGAGCACCTGCTTCTTCCTGTGCCTGCTGCGCTTCTGCTTCAGCGCCACCCGCCGCTACTACCTGGG<br>CGCCGTGGAGCTGAGCTGGGACTACATGCAGAGCGACCTGGGCGAGCTGCCCGTGGACGCCCGCTTCCCCCCCCGCGT<br>GCCCAAGAGCTTCCCCTTCAACACCAGCGTGGTGTACAAGAAGACCCTGTTCGTGGAGTTCACCGACCACCTGTTCAACA<br>TCGCCAAGCCCCGCCCCCCCTGGATGGGCCTGCTGGGCCCCACCATCCAGGCCGAGGTGTACGACACCGTGGTGATCAC<br>CCTGAAGAACATGGCCAGCCACCCCGTGAGCCTGCACGCCGTGGGCGTGAGCTACTGGAAGGCCAGCGAGGGCGCCG<br>AGTACGACGACCAGACCAGCCAGCGCGAGAAGGAGGACGACAAGGTGTTCCCCGGCGGCAGCCACACCTACGTGTGG<br>CAGGTGCTGAAGGAGAACGGCCCCATGGCCAGCGACCCCCTGTGCCTGACCTACAGCTACCTGAGCCACGTGGACCTG<br>GTGAAGGACCTGAACAGCGGCCTGATCGGCGCCCTGCTGGTGTGCCGCGAGGGCAGCCTGGCCAAGGAGAAGACCCA<br>GACCCTGCACAAGTTCATCCTGCTGTTCGCCGTGTTCGACGAGGGCAAGAGCTGGCACAGCGAGACCAAGAACAGCCT<br>GATGCAGGACCGCGACGCCGCCAGCGCCCGCGCCTGGCCCAAGATGCACACCGTGAACGGCTACGTGAACCGCAGCCT<br>GCCCGGCCTGATCGGCTGCCACCGCAAGAGCGTGTACTGGCACGTGATCGGCATGGGCACCACCCCCGAGGTGCACAG<br>CATCTTCCTGGAGGGCCACACCTTCCTGGTGCGCAACCACCGCCAGGCCAGCCTGGAGATCAGCCCCATCACCTTCCTGA<br>CCGCCCAGACCCTGCTGATGGACCTGGGCCAGTTCCTGCTGTTCTGCCACATCAGCAGCCACCAGCACGACGGCATGGA<br>GGCCTACGTGAAGGTGGACAGCTGCCCCGAGGAGCCCCAGCTGCGCATGAAGAACAACGAGGAGGCCGAGGACTACG<br>ACGACGACCTGACCGACAGCGAGATGGACGTGGTGCGCTTCGACGACGACAACAGCCCCAGCTTCATCCAGATCCGCA<br>GCGTGGCCAAGAAGCACCCCAAGACCTGGGTGCACTACATCGCCGCCGAGGAGGAGGACTGGGACTACGCCCCCCTG<br>GTGCTGGCCCCCGACGACCGCAGCTACAAGAGCCAGTACCTGAACAACGGCCCCCAGCGCATCGGCCGCAAGTACAAG<br>AAGGTGCGCTTCATGGCCTACACCGACGAGACCTTCAAGACCCGCGAGGCCATCCAGCACGAGAGCGGCATCCTGGGC<br>CCCCTGCTGTACGGCGAGGTGGGCGACACCCTGCTGATCATCTTCAAGAACCAGGCCAGCCGCCCCTACAACATCTACC<br>CCCACGGCATCACCGACGTGCGCCCCCTGTACAGCCGCCGCCTGCCCAAGGGCGTGAAGCACCTGAAGGACTTCCCCAT<br>CCTGCCCGGCGAGATCTTCAAGTACAAGTGGACCGTGACCGTGGAGGACGGCCCCACCAAGAGCGACCCCCGCTGCCT<br>GACCCGCTACTACAGCAGCTTCGTGAACATGGAGCGCGACCTGGCCAGCGGCCTGATCGGCCCCCTGCTGATCTGCTAC<br>AAGGAGAGCGTGGACCAGCGCGGCAACCAGATCATGAGCGACAAGCGCAACGTGATCCTGTTCAGCGTGTTCGACGA<br>GAACCGCAGCTGGTACCTGACCGAGAACATCCAGCGCTTCCTGCCCAACCCCGCCGGCGTGCAGCTGGAGGACCCCGA<br>GTTCCAGGCCAGCAACATCATGCACAGCATCAACGGCTACGTGTTCGACAGCCTGCAGCTGAGCGTGTGCCTGCACGAG<br>GTGGCCTACTGGTACATCCTGAGCATCGGCGCCCAGACCGACTTCCTGAGCGTGTTCTTCAGCGGCTACACCTTCAAGCA<br>CAAGATGGTGTACGAGGACACCCTGACCCTGTTCCCCTTCAGCGGCGAGACCGTGTTCATGAGCATGGAGAACCCCGGC<br>CTGTGGATCCTGGGCTGCCACAACAGCGACTTCCGCAACCGCGGCATGACCGCCCTGCTGAAGGTGAGCAGCTGCGAC<br>AAGAACACCGGCGACTACTACGAGGACAGCTACGAGGACATCAGCGCCTACCTGCTGAGCAAGAACAACGCCATCGAG<br>CCCCGCAGCTTCAGCCAGAACAGCCGCCACCCCAGCACCCGCCAGAAGCAGTTCAACGCCACCACCATCCCCGAGAACG<br>ACATCGAGAAGACCGACCCCTGGTTCGCCCACCGCACCCCCATGCCCAAGATCCAGAACGTGAGCAGCAGCGACCTGCT |

TABLE 1-continued

Exemplary FVIII sequences for treatment of hemophilia A
Exemplary nucleic acid sequences encoding Factor VIII

| Description | Length | Ref- erence | CG Content | SEQ ID NO: | Sequence |
|---|---|---|---|---|---|
| | | | | | GATGCTGCTGCGCCAGAGCCCCACCCCCCACGGCCTGAGCCTGAGCGACCTGCAAGAGGCCAAGTACGAGACCTTCAG<br>CGACGACCCCAGCCCCGGCGCCATCGACAGCAACAACAGCCTGAGCGAGATGACCCACTTCCGCCCCCAGCTGCACCAC<br>AGCGGCGACATGGTGTTCACCCCCGAGAGCGGCCTGCAGCTGCGCCTGAACGAGAAGCTGGGCACCACCGCCGCCACC<br>GAGCTGAAGAAGCTGGACTTCAAGGTGAGCAGCACCAGCAACAACCTGATCAGCACCATCCCCAGCGACAACCTGGCC<br>GCCGGCACCGACAACACCAGCAGCCTGGGCCCCCCCAGCATGCCCGTGCACTACGACAGCCAGCTGGACACCACCCTGT<br>TCGGCAAGAAGAGCAGCCCCCTGACCGAGAGCGGCGGCCCCCTGAGCCTGAGCGAGGAGAACAACGACAGCAAGCTG<br>CTGGAGAGCGGCCTGATGAACAGCCAGGAGAGCAGCTGGGGCAAGAACGTGAGCAGCACCGAGAGCGGCAGGCTGT<br>TCAAGGGCAAGCGCGCCCACGGCCCCGCCCTGCTGACCAAGGACAACGCCCTGTTCAAGGTGAGCATCAGCCTGCTGA<br>AGACCAACAAGACCAGCAACAACAGCGCCACCAACCGCAAGACCCACATCGACGGCCCCAGCCTGCTGATCGAGAACA<br>GCCCCAGCGTGTGGCAGAACATCCTGGAGAGCGACACCGAGTTCAAGAAGGTGACCCCCCTGATCCACGACCGCATGC<br>TGATGGACAAGAACGCCACCGCCCTGCGCCTGAACCACATGAGCAACAAGACCACCAGCAGCAAGAACATGGAGATGG<br>TGCAGCAGAAGAAGGAGGGCCCCATCCCCCCCGACGCCCAGAACCCCGACATGAGCTTCTTCAAGATGCTGTTCCTGCC<br>CGAGAGCGCCCGCTGGATCCAGCGCACCCACGGCAAGAACAGCCTGAACAGCGGCCAGGGCCCCAGCCCCAAGCAGC<br>TGGTGAGCCTGGGCCCCGAGAAGAGCGTGGAGGGCCAGAACTTCCTGAGCGAGAAGAACAAGGTGGTGGTGGGCAA<br>GGGCGAGTTCACCAAGGACGTGGGCCTGAAGGAGATGGTGTTCCCCAGCAGCCGCAACCTGTTCCTGACCAACCTGGA<br>CAACCTGCACGAGAACAACACCCACAACCAGGAGAAGAAGATCCAGGAGGAGATCGAGAAGAAGGAGACCCTGATCC<br>AGGAGAACGTGGTGCTGCCCCAGATCCACACCGTGACCGGCACCAAGAACTTCATGAAGAACCTGTTCCTGCTGAGCAC<br>CCGCCAGAACGTGGAGGGCAGCTACGACGGCGCCTACGCCCCCGTGCTGCAGGACTTCCGCAGCCTGAACGACAGCAC<br>CAACCGCACCAAGAAGCACACCGCCCACTTCAGCAAGAAGGGCGAGGAGGAGAACCTGGAGGGCCTGGGCAACCAGA<br>CCAAGCAGATCGTGGAGAAGTACGCCTGCACCACCCGCATCAGCCCCAACACCAGCCAGCAGAACTTCGTGACCCAGC<br>GCAGCAAGCGCGCCCTGAAGCAGTTCCGCCTGCCCCTGGAGGAGACCGAGCTGGAGAAGCGCATCATCGTGGACGAC<br>ACCAGCACCCAGTGGAGCAAGAACATGAAGCACCTGACCCCCAGCACCCTGACCCAGATCGACTACAACGAGAAGGAG<br>AAGGGCGCCATCACCCAGAGCCCCCTGAGCGACTGCCTGACCCGCAGCCACAGCATCCCCCAGGCCAACCGCAGCCCCC<br>TGCCCATCGCCAAGGTGAGCAGCTTCCCCAGCATCCGCCCCATCTACCTGACCCGCGTGCTGTTCCAGGACAACAGCAG<br>CCACCTGCCCGCCGCCAGCTACCGCAAGAAGGACAGCGGCGTGCAGGAGAGCAGCCACTTCCTGCAAGGCGCCAAGAA<br>GAACAACCTGAGCCTGGCCATCCTGACCCTGGAGATGACCGGCGACCAGCGCGAGGTGGGCAGCCTGGGCACCAGCG<br>CCACCAACAGCGTGACCTACAAGAAGGTGGAGAACACCGTGCTGCCCAAGCCCGACCTGCCCAAGACCAGCGGCAAGG<br>TGGAGCTGCTGCCCAAGGTGCACATCTACCAGAAGGACCTGTTCCCCACCGAGACCAGCAACGGCAGCCCCGGCCACCT<br>GGACCTGGTGGAGGGCAGCCTGCTGCAGGGCACCGAGGGCGCCATCAAGTGGAACGAGGCCAACCGCCCCGGCAAG<br>GTGCCCTTCCTGCGCGTGGCCACCGAGAGCAGCGCCAAGACCCCCAGCAAGCTGCTGGACCCCCTGGCCTGGGACAAC<br>CACTACGGCACCCAGATCCCCAAGGAGGAGTGGAAGAGCCAGGAGAAGAGCCCCGAGAAGACCGCCTTCAAGAAGAA<br>GGACACCATCCTGAGCCTGAACGCCTGCGAGAGCAACCACGCCATCGCCGCCATCAACGAGGGCCAGAACAAGCCCGA<br>GATCGAGGTGACCTGGGCCAAGCAGGGCCGCACCGAGCGCCTGTGCAGCCAGAACCCCCCCGTGCTGAAGCGCCACCA<br>GCGCGAGATCACCCGCACCACCCTGCAGAGCGACCAGGAGGAGATCGACTACGACGACACCATCAGCGTGGAGATGA<br>AGAAGGAGGACTTCGACATCTACGACGAGGACGAGAACCAGAGCCCCCGCAGCTTCCAGAAGAAGACCCGCCACTACT<br>TCATCGCCGCCGTGGAGCGCCTGTGGGACTACGGCATGAGCAGCAGCCCCCACGTGCTGCGCAACCGCGCCCAGAGCG<br>GCAGCGTGCCCCAGTTCAAGAAGGTGGTGTTCCAGGAGTTCACCGACGGCAGCTTCACCCAGCCCCTGTACCGCGGCG<br>AGCTGAACGAGCACCTGGGCCTGCTGGGCCCCTACATCCGCGCCGAGGTGGAGGACAACATCATGGTGACCTTCCGCA<br>ACCAGGCCAGCCGCCCCTACAGCTTCTACAGCAGCCTGATCAGCTACGAGGAGGACCAGCGCCAGGGCGCCGAGCCCC<br>GCAAGAACTTCGTGAAGCCCAACGAGACCAAGACCTACTTCTGGAAGGTGCAGCACCACATGGCCCCCACCAAGGACG<br>AGTTCGACTGCAAGGCCTGGGCCTACTTCAGCGACGTGGACCTGGAGAAGGACGTGCACAGCGGCCTGATCGGCCCCC<br>TGCTGGTGTGCCACACCAACACCCTGAACCCCGCCCACGGCCGCCAGGTGACCGTGCAGGAGTTCGCCCTGTTCTTCAC<br>CATCTTCGACGAGACCAAGAGCTGGTACTTCACCGAGAACATGGAGCGCAACTGCCGCGCCCCCTGCAACATCCAGATG<br>GAGGACCCCACCTTCAAGGAGAACTACCGCTTCCACGCCATCAACGGCTACATCATGGACACCCTGCCCGGCCTGGTGA<br>TGGCCCAGGACCAGCGCATCCGCTGGTACCTGCTGAGCATGGGCAGCAACGAGAACATCCACAGCATCCACTTCAGCG<br>GCCACGTGTTCACCGTGCGCAAGAAGGAGGAGTACAAGATGGCCCTGTACAACCTGTACCCCGGCGTGTTCGAGACCG |

TABLE 1-continued

Exemplary FVIII sequences for treatment of hemophilia A
Exemplary nucleic acid sequences encoding Factor VIII

| Description | Length | Ref-erence | CG Content | SEQ ID NO: | Sequence |
|---|---|---|---|---|---|
| | | | | | TGGAGATGCTGCCCAGCAAGGCCGGCATCTGGCGCGTGGAGTGCCTGATCGGCGAGCACCTGCACGCCGGCATGAGC<br>ACCCTGTTCCTGGTGTACAGCAACAAGTGCCAGACCCCCCTGGGCATGGCCAGCGGCCACATCCGCGACTTCCAGATCA<br>CCGCCAGCGGCCAGTACGGCCAGTGGGCCCCCAAGCTGGCCCGCCTGCACTACAGCGGCAGCATCAACGCCTGGAGCA<br>CCAAGGAGCCCTTCAGCTGGATCAAGGTGGACCTGCTGGCCCCCATGATCATCCACGGCATCAAGACCCAGGGCGCCC<br>GCCAGAAGTTCAGCAGCCTGTACATCAGCCAGTTCATCATCATGTACAGCCTGGACGGCAAGAAGTGGCAGACCTACCG<br>CGGCAACAGCACCGGCACCCTGATGGTGTTCTTCGGCAACGTGGACAGCAGCGGCATCAAGCACAACATCTTCAACCCC<br>CCCATCATCGCCCGCTACATCCGCCTGCACCCCACCCACTACAGCATCCGCAGCACCCTGCGCATGGAGCTGATGGGCTG<br>CGACCTGAACAGCTGCAGCATGCCCCTGGGCATGGAGAGCAAGGCCATCAGCGACGCCCAGATCACCGCCAGCAGCTA<br>CTTCACCAACATGTTCGCCACCTGGAGCCCCAGCAAGGCCCGCCTGCACCTGCAAGGCCGCAGCAACGCCTGGCGCCCC<br>CAGGTGAACAACCCCAAGGAGTGGCTGCAGGTGGACTTCCAGAAGACCATGAAGGTGACCGGCGTGACCACCCAGGG<br>CGTGAAGAGCCTGCTGACCAGCATGTACGTGAAGGAGTTCCTGATCAGCAGCAGCCAGGACGGCCACCAGTGGACCCT<br>GTTCTTCCAGAACGGCAAGGTGAAGGTGTTCCAGGGCAACCAGGACAGCTTCACCCCCGTGGTGAACAGCCTGGACCC<br>CCCCCTGCTGACCCGCTACCTGCGCATCCACCCCCAGAGCTGGGTGCACCAGATCGCCCTGCGCATGGAGGTGCTGGGC<br>TGCGAGGCCCAGGACCTGTACTAA |
| Jcat optimized B-domain deleted Human Factor VIII ORF | 4374 | | 307 | 390 | ATGCAGATCGAGCTGAGCACCTGCTTCTTCCTGTGCCTGCTGCGCTTCTGCTTCAGCGCCACCCGCCGCTACTACCTGGG<br>CGCCGTGGAGCTGAGCTGGGACTACATGCAGAGCGACCTGGGCGAGCTGCCCGTGGACGCCCGCTTCCCCCCCCGCGT<br>GCCCAAGAGCTTCCCCTTCAACACCAGCGTGGTGTACAAGAAGACCCTGTTCGTGGAGTTCACCGACCACCTGTTCAACA<br>TCGCCAAGCCCCGCCCCCCCTGGATGGGCCTGCTGGGCCCCACCATCCAGGCCGAGGTGTACGACACCGTGGTGATCAC<br>CCTGAAGAACATGGCCAGCCACCCCGTGAGCCTGCACGCCGTGGGCGTGAGCTACTGGAAGGCCAGCGAGGGCGCCG<br>AGTACGACGACCAGACCAGCCAGCGCGAGAAGGAGGACGACAAGGTGTTCCCCGGCGGCAGCCACACCTACGTGTGG<br>CAGGTGCTGAAGGAGAACGGCCCCATGGCCAGCGACCCCCTGTGCCTGACCTACAGCTACCTGAGCCACGTGGACCTG<br>GTGAAGGACCTGAACAGCGGCCTGATCGGCGCCCTGCTGGTGTGCCGCGAGGGCAGCCTGGCCAAGGAGAAGACCCA<br>GACCCTGCACAAGTTCATCCTGCTGTTCGCCGTGTTCGACGAGGGCAAGAGCTGGCACAGCGAGACCAAGAACAGCCT<br>GATGCAGGACCGCGACGCCGCCAGCGCCCGCGCCTGGCCCAAGATGCACACCGTGAACGGCTACGTGAACCGCAGCCT<br>GCCCGGCCTGATCGGCTGCCACCGCAAGAGCGTGTACTGGCACGTGATCGGCATGGGCACCACCCCCGAGGTGCACAG<br>CATCTTCCTGGAGGGCCACACCTTCCTGGTGCGCAACCACCGCCAGGCCAGCCTGGAGATCAGCCCCATCACCTTCCTGA<br>CCGCCCAGACCCTGCTGATGGACCTGGGCCAGTTCCTGCTGTTCTGCCACATCAGCAGCCACCAGCACGACGGCATGGA<br>GGCCTACGTGAAGGTGGACAGCTGCCCCGAGGAGCCCCAGCTGCGCATGAAGAACAACGAGGAGGCCGAGGACTACG<br>ACGACGACCTGACCGACAGCGAGATGGACGTGGTGCGCTTCGACGACGACAACAGCCCCAGCTTCATCCAGATCCGCA<br>GCGTGGCCAAGAAGCACCCCAAGACCTGGGTGCACTACATCGCCGCCGAGGAGGAGGACTGGGACTACGCCCCCCTG<br>GTGCTGGCCCCCGACGACCGCAGCTACAAGAGCCAGTACCTGAACAACGGCCCCCAGCGCATCGGCCGCAAGTACAAG<br>AAGGTGCGCTTCATGGCCTACACCGACGAGACCTTCAAGACCCGCGAGGCCATCCAGCACGAGAGCGGCATCCTGGGC<br>CCCCTGCTGTACGGCGAGGTGGGCGACACCCTGCTGATCATCTTCAAGAACCAGGCCAGCCGCCCCTACAACATCTACC<br>CCCACGGCATCACCGACGTGCGCCCCCTGTACAGCCGCCGCCTGCCCAAGGGCGTGAAGCACCTGAAGGACTTCCCCAT<br>CCTGCCCGGCGAGATCTTCAAGTACAAGTGGACCGTGACCGTGGAGGACGGCCCCACCAAGAGCGACCCCCGCTGCCT<br>GACCCGCTACTACAGCAGCTTCGTGAACATGGAGCGCGACCTGGCCAGCGGCCTGATCGGCCCCCTGCTGATCTGCTAC<br>AAGGAGAGCGTGGACCAGCGCGGCAACCAGATCATGAGCGACAAGCGCAACGTGATCCTGTTCAGCGTGTTCGACGA<br>GAACCGCAGCTGGTACCTGACCGAGAACATCCAGCGCTTCCTGCCCAACCCCGCCGGCGTGCAGCTGGAGGACCCCGA<br>GTTCCAGGCCAGCAACATCATGCACAGCATCAACGGCTACGTGTTCGACAGCCTGCAGCTGAGCGTGTGCCTGCACGAG<br>GTGGCCTACTGGTACATCCTGAGCATCGGCGCCCAGACCGACTTCCTGAGCGTGTTCTTCAGCGGCTACACCTTCAAGCA<br>CAAGATGGTGTACGAGGACACCCTGACCCTGTTCCCCTTCAGCGGCGAGACCGTGTTCATGAGCATGGAGAACCCCGGC<br>CTGTGGATCCTGGGCTGCCACAACAGCGACTTCCGCAACCGCGGCATGACCGCCCTGCTGAAGGTGAGCAGCTGCGAC<br>AAGAACACCGGCGACTACTACGAGGACAGCTACGAGGACATCAGCGCCTACCTGCTGAGCAAGAACAACGCCATCGAG<br>CCCCGCAGCTTCAGCCAGAACCCCCCCGTGCTGAAGCGCCACCAGCGCGAGATCACCCGCACCACCCTGCAGAGCGACC<br>AGGAGGAGATCGACTACGACGACACCATCAGCGTGGAGATGAAGAAGGAGGACTTCGACATCTACGACGAGGACGAG |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | AACCAGAGCCCCCGCAGCTTCCAGAAGAAGACCCGCCACTACTTCATCGCCGCCGTGGAGCGCCTGTGGGACTACGGC<br>ATGAGCAGCAGCCCCCACGTGCTGCGCAACCGCGCCCAGAGCGGCAGCGTGCCCCAGTTCAAGAAGGTGGTGTTCCAG<br>GAGTTCACCGACGGCAGCTTCACCCAGCCCCTGTACCGCGGCGAGCTGAACGAGCACCTGGGCCTGCTGGGCCCCTACA<br>TCCGCGCCGAGGTGGAGGACAACATCATGGTGACCTTCCGCAACCAGGCCAGCCGCCCCTACAGCTTCTACAGCAGCCT<br>GATCAGCTACGAGGAGGACCAGCGCCAGGGCGCCGAGCCCCGCAAGAACTTCGTGAAGCCCAACGAGACCAAGACCT<br>ACTTCTGGAAGGTGCAGCACCACATGGCCCCCACCAAGGACGAGTTCGACTGCAAGGCCTGGGCCTACTTCAGCGACGT<br>GGACCTGGAGAAGGACGTGCACAGCGGCCTGATCGGCCCCCTGCTGGTGTGCCACACCAACACCCTGAACCCCGCCCA<br>CGGCCGCCAGGTGACCGTGCAGGAGTTCGCCCTGTTCTTCACCATCTTCGACGAGACCAAGAGCTGGTACTTCACCGAG<br>AACATGGAGCGCAACTGCCGCGCCCCCTGCAACATCCAGATGGAGGACCCCACCTTCAAGGAGAACTACCGCTTCCACG<br>CCATCAACGGCTACATCATGGACACCCTGCCCGGCCTGGTGATGGCCCAGGACCAGCGCATCCGCTGGTACCTGCTGAG<br>CATGGGCAGCAACGAGAACATCCACAGCATCCACTTCAGCGGCCACGTGTTCACCGTGCGCAAGAAGGAGGAGTACAA<br>GATGGCCCTGTACAACCTGTACCCCGGCGTGTTCGAGACCGTGGAGATGCTGCCCAGCAAGGCCGGCATCTGGCGCGT<br>GGAGTGCCTGATCGGCGAGCACCTGCACGCCGGCATGAGCACCCTGTTCCTGGTGTACAGCAACAAGTGCCAGACCCC<br>CCTGGGCATGGCCAGCGGCCACATCCGCGACTTCCAGATCACCGCCAGCGGCCAGTACGGCCAGTGGGCCCCCAAGCT<br>GGCCCGCCTGCACTACAGCGGCAGCATCAACGCCTGGAGCACCAAGGAGCCCTTCAGCTGGATCAAGGTGGACCTGCT<br>GGCCCCCATGATCATCCACGGCATCAAGACCCAGGGCGCCCGCCAGAAGTTCAGCAGCCTGTACATCAGCCAGTTCATC<br>ATCATGTACAGCCTGGACGGCAAGAAGTGGCAGACCTACCGCGGCAACAGCACCGGCACCCTGATGGTGTTCTTCGGC<br>AACGTGGACAGCAGCGGCATCAAGCACAACATCTTCAACCCCCCCATCATCGCCCGCTACATCCGCCTGCACCCCACCCA<br>CTACAGCATCCGCAGCACCCTGCGCATGGAGCTGATGGGCTGCGACCTGAACAGCTGCAGCATGCCCCTGGGCATGGA<br>GAGCAAGGCCATCAGCGACGCCCAGATCACCGCCAGCAGCTACTTCACCAACATGTTCGCCACCTGGAGCCCCAGCAAG<br>GCCCGCCTGCACCTGCAAGGCCGCAGCAACGCCTGGCGCCCCCAGGTGAACAACCCCAAGGAGTGGCTGCAGGTGGAC<br>TTCCAGAAGACCATGAAGGTGACCGGCGTGACCACCCAGGGCGTGAAGAGCCTGCTGACCAGCATGTACGTGAAGGA<br>GTTCCTGATCAGCAGCAGCCAGGACGGCCACCAGTGGACCCTGTTCTTCCAGAACGGCAAGGTGAAGGTGTTCCAGGG<br>CAACCAGGACAGCTTCACCCCCGTGGTGAACAGCCTGGACCCCCCCCTGCTGACCCGCTACCTGCGCATCCACCCCCAGA<br>GCTGGGTGCACCAGATCGCCCTGCGCATGGAGGTGCTGGGCTGCGAGGCCCAGGACCTGTACTAA |
| Human Full Length FVIII ORF (codon optimized) | 7056 | | 323 | 391 | ATGCAGATCGAGCTGTCTACCTGCTTCTTCCTGTGCCTGCTGCGGTTCTGCTTCAGCGCCACCAGAAGATATTACCTGGG<br>CGCCGTGGAACTGAGCTGGGACTACATGCAGTCTGACCTGGGAGAGCTGCCCGTGGACGCTAGATTTCCTCCAAGAGT<br>GCCCAAGAGCTTCCCCTTCAACACCTCCGTGGTGTACAAGAAAACCCTGTTCGTGGAATTCACCGACCACCTGTTCAATA<br>TCGCCAAGCCTCGGCCTCCTTGGATGGGACTGCTGGGACCTACAATTCAGGCCGAGGTGTACGACACCGTGGTCATCAC<br>CCTGAAGAACATGGCCAGCCATCCTGTGTCTCTGCACGCCGTGGGAGTGTCTTATTGGAAGGCTTCTGAGGGCGCCGAG<br>TACGACGATCAGACAAGCCAGAGAGAGAAAGAGGACGACAAGGTTTTCCCTGGCGGCAGCCACACCTATGTCTGGCAG<br>GTCCTGAAAGAAAACGGCCCTATGGCCTCCGATCCTCTGTGCCTGACATACAGCTACCTGAGCCACGTGGACCTGGTCA<br>AGGACCTGAATTCTGGCCTGATCGGAGCCCTGCTCGTGTGTAGAGAAGGCAGCCTGGCCAAAGAGAAAACCCAGACAC<br>TGCACAAGTTCATCCTGCTGTTCGCCGTGTTCGACGAGGGCAAGAGCTGGCACAGCGAGACAAAGAACAGCCTGATGC<br>AGGACAGGGATGCCGCCTCTGCTAGAGCTGGCCTAAGATGCACACCGTGAACGGCTACGTGAACAGAAGCCTGCCTG<br>GACTGATCGGCTGCCACAGAAAGTCCGTGTACTGGCACGTGATCGGCATGGGCACAACACCTGAGGTGCACAGCATCT<br>TTCTGGAAGGCCACACCTTCCTCGTGCGGAACCACAGACAGGCCAGCCTGGAAATCAGCCCTATCACCTTCCTGACCGCT<br>CAGACCCTGCTGATGGATCTGGGCCAGTTTCTGCTGTTCTGCCACATCAGCTCCCACCAGCACGATGGCATGGAAGCCT<br>ACGTGAAGGTGGACAGCTGCCCCGAAGAACCCCAGCTGCGGATGAAGAACAACGAGGAAGCCGAGGACTACGACGAC<br>GACCTGACCGACTCTGAGATGGACGTCGTCAGATTCGACGACGATAACAGCCCCAGCTTCATCCAGATCAGAAGCGTGG<br>CCAAGAAGCACCCCAAGACCTGGGTGCACTATATCGCCGCCGAGGAAGAGGACTGGGATTACGCTCCTCTGGTGCTGG<br>CCCCTGACGACAGAAGCTACAAGAGCCAGTACCTGAACAACGGCCCTCAGCGGATCGGCCGGAAGTATAAGAAAGTGC<br>GGTTCATGGCCTACACCGACGAGACATTCAAGACCAGAGAGGCCATCCAGCACGAGAGCGGAATTCTGGGCCCTCTGC<br>TGTATGGCGAAGTGGGCGATACACTGCTGATCATCTTCAAGAACCAGGCCAGCAGACCCTACAACATCTACCCTCACGG<br>CATCACCGATGTGCGGCCCCTGTATTCTAGAAGGCTGCCCAAGGGCGTGAAGCACCTGAAGGACTTCCCTATCCTGCCT |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | GGCGAGATTTTCAAGTACAAGTGGACCGTGACCGTGGAAGATGGCCCCACCAAGAGCGACCCTAGATGTCTGACACGG |
| | | | | | TACTACAGCAGCTTCGTGAACATGGAACGCGACCTGGCCAGCGGCCTGATTGGACCTCTGCTGATCTGCTACAAAGAAA |
| | | | | | GCGTGGACCAGCGGGGCAACCAGATCATGAGCGACAAGCGGAACGTGATCCTGTTTAGCGTGTTCGATGAGAACCGGT |
| | | | | | CCTGGTATCTGACCGAGAACATCCAGCGGTTTCTGCCCAATCCTGCCGGGGTGCAACTGGAAGATCCTGAGTTCCAGGC |
| | | | | | AAGCAACATCATGCACTCCATCAATGGCTATGTGTTCGACAGCCTGCAGCTGAGCGTGTGCCTGCACGAAGTGGCCTAC |
| | | | | | TGGTACATCCTGAGCATTGGCGCCCAGACCGACTTCCTGTCCGTGTTCTTTAGCGGCTACACCTTCAAGCACAAGATGGT |
| | | | | | GTACGAGGATACCCTGACACTGTTCCCATTCAGCGGCGAGACAGTGTTCATGAGCATGGAAAACCCCGGCCTGTGGATT |
| | | | | | CTGGGCTGTCACAACAGCGACTTCCGGAACAGAGGCATGACAGCCCTGCTGAAGGTGTCCAGCTGCGACAAGAACACC |
| | | | | | GGCGACTACTACGAGGACAGCTATGAGGACATCAGCGCCTACCTGCTGAGCAAGAACAATGCCATCGAGCCCAGAAGC |
| | | | | | TTCAGCCAGAATAGCAGACACCCCTCCACCAGACAGAAGCAGTTCAACGCCACAACAATCCCCGAGAACGACATCGAGA |
| | | | | | AAACCGATCCTTGGTTTGCCCACAGAACCCCTATGCCTAAGATCCAGAACGTGTCCTCCAGCGATCTGCTGATGCTCCTG |
| | | | | | AGACAGAGCCCTACACCTCACGGACTGAGCCTGTCCGATCTGCAAGAGGCCAAATACGAAACCTTCAGCGACGACCCTT |
| | | | | | CTCCTGGCGCCATCGACAGCAACAATAGCCTGAGCGAGATGACCCACTTCAGACCACAGCTGCACCACAGCGGCGACAT |
| | | | | | GGTGTTTACACCTGAGAGCGGCCTCCAGCTGAGACTGAATGAGAAGCTGGGAACCACCGCCGCCACCGAGCTGAAGAA |
| | | | | | ACTGGACTTCAAGGTGTCCTCTACCAGCAACAACCTGATCAGCACAATCCCCTCCGACAACCTGGCTGCCGGCACCGACA |
| | | | | | ACACATCTTCTCTGGGCCCACCTAGCATGCCCGTGCACTACGATAGCCAGCTGGATACCACACTGTTCGGCAAGAAGTCT |
| | | | | | AGCCCTCTGACAGAGTCTGGCGGCCCTCTGTCTCTGAGCGAGGAAAACAACGACAGCAAGCTGCTGGAATCCGGCCTG |
| | | | | | ATGAACAGCCAAGAGTCCTCCTGGGGCAAGAATGTGTCCAGCACCGAGTCCGGCAGACTGTTCAAGGGAAAGAGAGCC |
| | | | | | CACGGACCTGCTCTGCTGACCAAGGATAACGCCCTGTTCAAAGTGTCCATCAGCCTGCTCAAGACCAACAAGACCTCCA |
| | | | | | ACAACTCCGCCACCAACAGAAAGACCCACATCGACGGCCCTAGCCTGCTGATCGAGAATAGCCCTAGCGTCTGGCAGAA |
| | | | | | TATCCTGGAAAGCGACACCGAGTTCAAGAAAGTGACCCCTCTGATCCACGACCGGATGCTCATGGACAAGAACGCCACC |
| | | | | | GCTCTGCGGCTGAACCACATGAGCAACAAGACAACCAGCAGCAAGAATATGGAAATGGTGCAGCAGAAGAAAGAGGG |
| | | | | | CCCCATTCCTCCAGACGCTCAGAACCCCGATATGAGCTTCTTCAAGATGCTCTTTCTGCCCGAGAGCGCCCGGTGGATTC |
| | | | | | AGAGAACACACGGCAAGAACTCCCTGAACTCCGGCCAGGGACCTTCTCCAAAGCAGCTGGTTTCCCTGGGACCTGAGA |
| | | | | | AGTCCGTGGAAGGACAGAACTTCCTGAGCGAAAAGAACAAAGTGGTCGTCGGCAAGGGCGAGTTCACCAAGGATGTG |
| | | | | | GGCCTGAAAGAGATGGTCTTTCCCAGCAGCCGGAACCTGTTCCTGACCAACCTGGACAACCTGCACGAGAACAACACCC |
| | | | | | ACAATCAAGAGAAGAAGATCCAAGAGGAAATCGAAAAGAAAGAGACACTCATCCAAGAGAACGTGGTGCTGCCTCAG |
| | | | | | ATCCACACAGTGACCGGCACCAAGAACTTTATGAAGAATCTGTTCCTGCTGAGTACCCGGCAGAACGTGGAAGGCAGCT |
| | | | | | ACGATGGCGCTTATGCCCCTGTGCTGCAGGACTTCAGATCCCTGAACGACTCCACCAATCGGACAAAGAAGCACACAGC |
| | | | | | CCACTTCTCCAAGAAGGGCGAAGAAGAGAACCTGGAAGGACTGGGCAATCAGACCAAGCAGATCGTCGAGAAGTACG |
| | | | | | CCTGCACCACCAGAATCAGCCCCAACACAAGCCAGCAGAACTTCGTGACCCAGCGGAGCAAAAGAGCCCTGAAGCAGT |
| | | | | | TCGGCTGCCCCTGGAAGAAACCGAGCTGGAAAAGCGGATCATCGTGGACGACACCAGCACACAGTGGTCCAAGAACA |
| | | | | | TGAAGCACTTGACCCCTAGCACACTGACCCAGATCGACTACAACGAGAAAGAGAAGGGCGCTATCACACAGAGCCCAC |
| | | | | | TGAGCGACTGTCTGACCAGAAGCCACAGCATCCCTCAGGCCAACAGATCCCCTCTGCCAATCGCCAAAGTGTCTAGCTTC |
| | | | | | CCCAGCATCAGACCCATCTACCTGACCAGAGTGCTGTTCCAGGACAACAGCAGCCATCTGCCAGCCGCCAGCTACCGGA |
| | | | | | AGAAAGATTCTGGCGTGCAAGAGAGCAGCCACTTTCTGCAGGGCGCTAAGAAGAACAATCTGAGCCTGGCTATTCTGA |
| | | | | | CCCTGGAAATGACCGGCGATCAGAGAGAAGTCGGCTCTCTGGGCACCAGCGCCACAAATAGCGTGACCTACAAAAAGG |
| | | | | | TGGAAAACACCGTGCTGCCTAAGCCTGACCTGCCAAAGACAAGCGGCAAGGTGGAACTGCTGCCAAAGGTGCACATCT |
| | | | | | ACCAGAAGGACCTGTTTCCTACCGAGACAAGCAACGGCTCTCCCGGCCATCTGGATCTGGTGGAAGGATCTCTGCTGCA |
| | | | | | GGGAACCGAGGGCGCCATCAAGTGGAACGAGGCCAATAGACCTGGCAAGGTGCCCTTCCTGAGAGTGGCCACAGAGT |
| | | | | | CCAGCGCCAAGACACCCTCTAAACTGCTGGACCCTCTGGCCTGGGACAACCACTATGGCACTCAGATCCCCAAAGAGGA |
| | | | | | ATGGAAGTCCCAAGAGAAGTCCCCTGAAAAGACCGCCTTCAAGAAGAAGGACACCATTCTGTCCCTGAATGCCTGCGA |
| | | | | | GAGCAACCACGCCATTGCCGCCATCAATGAGGGCCAGAACAAGCCCGAGATCGAAGTGACCTGGGCCAAGCAGGGAA |
| | | | | | GAACCGAGAGACTGTGTAGCCAGAATCCTCCTGTGCTGAAGCGGCACCAGAGAGAAATCACCCGGACCACACTGCAGA |
| | | | | | GCGACCAAGAAGAGATCGATTACGACGATACCATCAGCGTCGAGATGAAGAAAGAAGATTTCGACATCTACGACGAGG |
| | | | | | ACGAGAATCAGAGCCCTCGGAGCTTCCAGAAGAAAACCAGGCACTACTTTATTGCCGCCGTCGAGCGGCTGTGGGACT |

TABLE 1-continued

Exemplary FVIII sequences for treatment of hemophilia A
Exemplary nucleic acid sequences encoding Factor VIII

| Description | Length | Ref-erence | CG Content | SEQ ID NO: | Sequence |
|---|---|---|---|---|---|
| | | | | | ACGGAATGTCTAGCTCTCCTCACGTGCTGCGGAATAGAGCCCAGTCTGGTAGCGTGCCCCAGTTCAAAAAGGTCGTGTT CCAAGAGTTCACCGACGGCAGCTTCACCCAGCCACTGTATAGAGGCGAGCTGAACGAGCATCTGGGCCTGCTGGGCCC TTATATCAGAGCCGAAGTGGAAGATAACATCATGGTCACCTTCCGGAATCAGGCTAGCCGGCCTTACAGCTTCTACAGC TCCCTGATCTCCTACGAAGAGGACCAGAGACAGGGCGCAGAGCCCCGGAAGAATTTCGTGAAGCCCAACGAGACTAAG ACCTACTTTTGGAAGGTGCAGCACCATATGGCCCCTACAAAGGACGAGTTCGACTGCAAAGCCTGGGCCTACTTCTCCG ATGTGGACCTCGAAAAGGACGTGCACAGCGGACTCATCGGCCCACTGCTTGTGTGCCACACCAACACACTGAACCCCGC TCACGGCAGACAAGTGACAGTGCAAGAGTTCGCCCTGTTTTTCACCATCTTCGACGAAACGAAGTCCTGGTACTTCACCG AAAACATGGAAAGAAACTGCAGGGCCCCTTGCAACATTCAGATGGAAGATCCCACCTTCAAAGAGAACTACCGGTTCCA CGCCATCAACGGCTACATCATGGACACACTGCCCGGCCTGGTTATGGCCCAGGATCAGAGAATCCGGTGGTATCTGCTG TCCATGGGCTCCAACGAGAATATCCACTCCATCCACTTCAGCGGCCACGTGTTCACCGTGCGGAAAAAAGAAGAGTACA AAATGGCCCTGTACAATCTGTACCCTGGGGTGTTCGAAACCGTTGAGATGCTGCCTAGCAAGGCCGGAATTTGGAGAGT GGAATGTCTGATTGGAGAGCACCTCCACGCCGGGATGAGCACCCTGTTTCTGGTGTACTCCAACAAGTGTCAGACCCCT CTCGGCATGGCCTCTGGCCACATTAGAGACTTCCAGATCACCGCCAGCGGACAGTATGGACAGTGGGCCCCTAAACTGG CCAGACTGCACTACTCCGGCAGCATCAATGCCTGGTCCACCAAAGAGCCTTTCAGCTGGATCAAAGTGGACCTGCTGGC TCCCATGATCATCCACGGAATCAAGACCCAGGGCGCCAGACAAAAGTTCAGCAGCCTGTACATCAGCCAGTTCATCATC ATGTACAGCCTGGACGGAAAGAAGTGGCAGACCTACCGGGGCAATAGCACCGGCACACTGATGGTGTTCTTCGGCAAC GTGGACTCCAGCGGCATTAAGCACAACATCTTCAACCCTCCAATCATTGCCCGGTACATCCGGCTGCACCCCACACACTA CAGCATCAGGTCTACCCTGAGAATGGAACTGATGGGCTGCGACCTGAACAGCTGCTCTATGCCCCTCGGAATGGAAAGC AAGGCCATCAGCGACGCCCAGATCACAGCCTCTAGCTACTTCACCAACATGTTCGCCACTTGGAGCCCCTCTAAGGCCCG GCTTCATCTGCAAGGCAGAAGCAACGCTTGGAGGCCCCAAGTGAACAACCCCAAAGAATGGCTCCAGGTGGACTTTCA GAAAACCATGAAAGTGACAGGCGTGACCACACAGGGCGTCAAGTCCCTGCTGACCTCTATGTACGTGAAAGAGTTTCTG ATCAGCTCCAGCCAGGACGGCCACCAGTGGACCCTGTTCTTCCAGAACGGCAAAGTGAAAGTGTTCCAGGGAAATCAG GACAGCTTCACACCCGTGGTCAATAGTCTGGACCCACCACTGCTGACCCGCTACCTGCGAATTCACCCTCAGTCTTGGGT GCACCAGATTGCCCTGCGGATGGAAGTGCTGGGCTGTGAAGCTCAGGACCTCTACTAG |
| Codon Optimized Human Factor VIII 206-variant ORF | 4980 | | 241 | 392 | ATGCAGATCGAGCTGTCTACCTGCTTCTTCCTGTGCCTGCTGCGGTTCTGCTTCAGCGCCACCAGAAGATATTACCTGGG CGCCGTGGAACTGAGCTGGGACTACATGCAGTCTGACCTGGGAGAGCTGCCCGTGGACGCTAGATTTCCTCCAAGAGT GCCCAAGAGCTTCCCCTTCAACACCTCCGTGGTGTACAAGAAAACCCTGTTCGTGGAATTCACCGACCACCTGTTCAATA TCGCCAAGCCTCGGCCTCCTTGGATGGGACTGCTGGGACCTACAATTCAGGCCGAGGTGTACGACACCGTGGTCATCAC CCTGAAGAACATGGCCAGCCATCCTGTGTCTCTGCACGCCGTGGGAGTGTCTTATTGGAAGGCTTCTGAGGGCGCCGAG TACGACGATCAGACAAGCCAGAGAGAGAAAGAGGACGACAAGGTTTTCCCTGGCGGCAGCCACACCTATGTCTGGCAG GTCCTGAAAGAAAACGGCCCTATGGCCTCCGATCCTCTGTGCCTGACATACAGCTACCTGAGCCACGTGGACCTGGTCA AGGACCTGAATTCTGGCCTGATCGGAGCCCTGCTCGTGTGTAGAGAAGGCAGCCTGGCCAAAGAGAAAACCCAGACAC TGCACAAGTTCATCCTGCTGTTCGCCGTGTTCGACGAGGGCAAGAGCTGGCACAGCGAGACAAAGAACAGCCTGATGC AGGACAGGGATGCCGCCTCTGCTAGAGCTTGGCCTAAGATGCACACCGTGAACGGCTACGTGAACAGAAGCCTGCCTG GACTGATCGGCTGCCACAGAAAGTCCGTGTACTGGCACGTGATCGGCATGGGCACAACACCTGAGGTGCACAGCATCT TTCTGGAAGGCCACACCTTCCTCGTGCGGAACCACAGACAGGCCAGCCTGGAAATCAGCCCTATCACCTTCCTGACCGCT CAGACCCTGCTGATGGATCTGGGCCAGTTTCTGCTGTTCTGCCACATCAGCTCCCACCAGCACGATGGCATGGAAGCCT ACGTGAAGGTGGACAGCTGCCCCGAAGAACCCCAGCTGCGGATGAAGAACAACGAGGAAGCCGAGGACTACGACGAC GACCTGACCGACTCTGAGATGGACGTCGTCAGATTCGACGACGATAACAGCCCCAGCTTCATCCAGATCAGAAGCGTGG CCAAGAAGCACCCCAAGACCTGGGTGCACTATATCGCCGCCGAGGAAGAGGACTGGGATTACGCTCCTCTGGTGCTGG CCCCTGACGACAGAAGCTACAAGAGCCAGTACCTGAACAACGGCCCTCAGCGGATCGGCCGGAAGTATAAGAAAGTGC GGTTCATGGCCTACACCGACGAGACATTCAAGACCAGAGAGGCCATCCAGCACGAGAGCGGAATTCTGGGCCCTCTGC TGTATGGCGAAGTGGGCGATACACTGCTGATCATCTTCAAGAACCAGGCCAGCAGACCCTACAACATCTACCCTCACGG CATCACCGATGTGCGGCCCCTGTATTCTAGAAGGCTGCCCAAGGGCGTGAAGCACCTGAAGGACTTCCCTATCCTGCCT GGCGAGATTTTCAAGTACAAGTGGACCGTGACCGTGGAAGATGGCCCCACCAAGAGCGACCCTAGATGTCTGACACGG |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | TACTACAGCAGCTTCGTGAACATGGAACGCGACCTGGCCAGCGGCCTGATTGGACCTCTGCTGATCTGCTACAAAGAAA GCGTGGACCAGCGGGGCAACCAGATCATGAGCGACAAGCGGAACGTGATCCTGTTTAGCGTGTTCGATGAGAACCGGT CCTGGTATCTGACCGAGAACATCCAGCGGTTTCTGCCCAATCCTGCCGGGGTGCAACTGGAAGATCCTGAGTTCCAGGC AAGCAACATCATGCACTCCATCAATGGCTATGTGTTCGACAGCCTGCAGCTGAGCGTGTGCCTGCACGAAGTGGCCTAC TGGTACATCCTGAGCATTGGCGCCCAGACCGACTTCCTGTCCGTGTTCTTTAGCGGCTACACCTTCAAGCACAAGATGGT GTACGAGGATACCCTGACACTGTTCCCATTCAGCGGCGAGACAGTGTTCATGAGCATGGAAAACCCCGGCCTGTGGATT CTGGGCTGTCACAACAGCGACTTCCGGAACAGAGGCATGACAGCCCTGCTGAAGGTGTCCAGCTGCGACAAGAACACC GGCGACTACTACGAGGACAGCTATGAGGACATCAGCGCCTACCTGCTGAGCAAGAACAATGCCATCGAGCCCAGAAGC TTCAGCCAGAATAGCAGACACCCCTCCACCAGACAGAAGCAGTTCAACGCCACAACAATCCCCGAGAACGACATCGAGA AAACCGATCCTTGGTTTGCCCACAGAACCCCTATGCCTAAGATCCAGAACGTGTCCTCCAGCGATCTGCTGATGCTCCTG AGACAGAGCCCTACACCTCACGGACTGAGCCTGTCCGATCTGCAAGAGGCCAAATACGAAACCTTCAGCGACGACCCTT CTCCTGGCGCCATCGACAGCAACAATAGCCTGAGCGAGATGACCCACTTCAGACCACAGCTGCACCACAGCGGCGACAT GGTGTTTACACCTGAGAGCGGCCTCCAGCTGAGACTGAATGAGAAGCTGGGAACCACCGCCGCCACCGAGCTGAAGAA ACTGGACTTCAAGGTGTCCTCTACCAGCAACAACCTGATCAGCACAATCCCCTCCGACAACCTGGCTGCCGGCACCGACA ACACATCTTCTCTGGGCCCACCTAGCATGCCCGTGCACTACGATAGCCAGCTGGATACCACACTGTTCGGCAAGAAGTCT AGCCCTCTGACAGAGTCTGGCGGCCCTCTGTCTCTGAGCGAGGAAAACAACGACAGCAAGCTGCCTCCTGTGCTGAAGC GGCACCAGCGGGAAATCACCAGAACCACACTGCAGAGCGACCAAGAGGAAATCGATTACGACGACACCATCAGCGTCG AGATGAAGAAAGAAGATTTCGACATCTACGACGAGGACGAGAATCAGAGCCCCAGATCCTTTCAGAAAAAGACCCGGC ACTACTTCATTGCCGCCGTCGAGAGACTGTGGGACTACGGCATGTCTAGCAGCCCTCACGTGCTGAGAAATAGAGCCCA GAGCGGCAGCGTGCCCCAGTTCAAGAAAGTGGTGTTCCAAGAGTTCACCGACGGCAGCTTCACCCAGCCACTGTATAG AGGCGAGCTGAACGAGCATCTGGGCCTGCTGGGCCCTTATATCAGAGCCGAAGTGGAAGATAACATCATGGTCACCTT CCGGAATCAGGCTAGCCGGCCTTACAGCTTCTACAGCTCCCTGATCTCCTACGAAGAGGACCAGAGACAGGGCGCTGA GCCCCGGAAGAATTTCGTGAAGCCCAACGAGACTAAGACCTACTTTTGGAAGGTGCAGCACCACATGGCCCCTACAAAG GACGAGTTCGACTGCAAAGCCTGGGCCTACTTCTCCGATGTGGATCTGGAAAAGGACGTGCACAGCGGGCTCATCGGA CCACTGCTTGTGTGCCACACCAACACACTGAACCCCGCTCACGGCAGACAAGTGACAGTGCAAGAGTTCGCCCTGTTCTT CACCATCTTCGACGAAACAAAGAGCTGGTACTTCACCGAGAATATGGAACGGAACTGCAGGGCCCCTTGCAACATCCAG ATGGAAGATCCCACCTTCAAAGAGAACTACCGGTTCCACGCCATCAACGGCTACATCATGGACACACTGCCCGGCCTGG TTATGGCCCAGGATCAGAGAATCCGGTGGTATCTGCTGTCCATGGGCTCCAACGAGAATATCCACAGCATCCACTTCAG CGGCCACGTGTTCACCGTGCGGAAAAAAGAAGAGTACAAAATGGCCCTGTACAATCTGTACCCTGGGGTGTTCGAAAC CGTGGAAATGCTGCCTTCCAAGGCCGGCATTTGGAGAGTGGAATGTCTGATTGGAGAGCACCTCCACGCCGGAATGAG CACCCTGTTTCTGGTGTACTCCAACAAGTGTCAGACCCCTCTCGGCATGGCCTCTGGACACATCAGAGACTTCCAGATCA CCGCCTCTGGCCAGTACGGACAGTGGGCTCCTAAACTGGCTCGGCTGCACTACTCCGGCAGCATCAATGCCTGGTCCAC CAAAGAGCCCTTCAGCTGGATCAAGGTGGACCTGCTGGCTCCCATGATCATCCACGGAATCAAGACCCAGGGCGCAAG ACAGAAGTTCAGCAGCCTGTACATCAGCCAGTTCATCATCATGTACAGCCTGGACGGAAAGAAGTGGCAGACCTACCG GGGCAATAGCACCGGCACACTCATGGTGTTCTTCGGCAACGTGGACTCCAGCGGCATTAAGCACAACATCTTCAACCCT CCAATCATTGCCCGGTACATCCGGCTGCACCCCACACACTACAGCATCCGGTCTACCCTGAGAATGGAACTGATGGGCT GCGACCTGAACAGCTGCTCTATGCCCCTCGGAATGGAAAGCAAGGCCATCAGCGACGCCCAGATCACAGCCAGCAGCT ACTTCACCAACATGTTCGCCACTTGGAGCCCCTCCAAGGCTAGACTGCATCTGCAGGGCAGAAGCAACGCTTGGAGGCC CCAAGTGAACAACCCCAAAGAGTGGCTGCAGGTTGACTTTCAAAAGACCATGAAAGTGACCGGCGTGACCACACAGGG CGTCAAGTCTCTGCTGACCTCTATGTACGTGAAAGAGTTCCTGATTAGCAGCAGCCAGGACGGCCACCAGTGGACCCTG TTTTTCCAGAACGGCAAAGTGAAAGTGTTCCAGGGCAATCAGGACAGCTTCACACCCGTGGTCAATTCTCTGGACCCTCC ACTGCTGACCAGATACCTGCGGATTCACCCTCAGTCTTGGGTGCACCAGATCGCTCTGCGGATGGAAGTGCTGGGCTGT GAAGCTCAGGACCTCTACTAG |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| CpG-free human hFVIII BDD COOL optimized | 4374 | | 1 | 393 | ATGCAGATAGAATTATCTACTTGTTTTTTTCTTTGTCTGCTCAGGTTCTGCTTCTCTGCTACAAGGAGGTATTACTTAGGT<br>GCTGTAGAGTTATCTTGGGACTACATGCAGTCTGATCTTGGGGAGCTCCCTGTGGATGCAAGATTTCCCCCTAGAGTACC<br>TAAAAGTTTCCCTTTCAACACAAGTGTGGTGTATAAGAAGACTCTGTTTGTTGAGTTCACAGATCACCTTTTCAATATTGC<br>CAAGCCCAGACCCCCCTGGATGGGTCTACTGGGGCCAACAATTCAAGCAGAGGTATATGATACAGTGGTGATCACATTA<br>AAGAACATGGCATCCCACCCTGTAAGCCTGCATGCTGTTGGTGTGTCCTATTGGAAAGCAAGTGAAGGTGCTGAATATG<br>ATGATCAAACATCCCAAAGAGAGAAGGAAGATGACAAAGTCTTCCCAGGTGGCTCTCACACCTATGTGTGGCAAGTGCT<br>CAAGGAAAATGGGCCTATGGCTAGTGATCCATTGTGCCTCACATATAGCTACCTGTCCCATGTGGACTTAGTTAAAGATC<br>TGAACTCAGGTCTGATTGGTGCCCTGCTGGTCTGTAGGGAAGGATCACTAGCTAAAGAAAAAACCCAGACTTTACACAA<br>GTTCATCTTATTATTTGCTGTTTTTGATGAGGGAAAGAGCTGGCACTCAGAGACTAAGAATTCACTCATGCAGGATAGA<br>GATGCAGCTTCTGCTAGAGCATGGCCAAAAATGCATACTGTGAATGGGTATGTTAACAGGAGTCTGCCTGGCCTCATAG<br>GCTGCCATAGAAAATCAGTGTACTGGCATGTCATAGGTATGGGCACTACTCCTGAGGTGCATTCCATTTTTTTGGAGGG<br>GCATACTTTCCTTGTAAGAAACCACAGGCAGGCTTCATTGGAAATTAGTCCAATAACCTTTCTCACAGCCCAGACTCTGCT<br>AATGGACTTGGGGCAGTTTTTATTATTTTGTCACATTAGCTCTCATCAGCATGATGGAATGGAAGCCTATGTTAAGGTTG<br>ATTCCTGCCCAGAAGAGCCCCAGTTGAGAATGAAGAACAATGAGGAAGCAGAAGACTATGATGATGATCTAACAGACT<br>CAGAAATGGATGTTGTGAGATTTGATGATGATAACTCCCCAAGTTTTATTCAGATCAGGTCAGTGGCCAAGAAACATCC<br>AAAAACATGGGTTCATTATATTGCAGCAGAAGAAGAAGACTGGGATTATGCACCCTTGGTATTAGCCCCTGATGACAGA<br>AGCTATAAGTCACAATATCTCAACAATGGACCCCAGAGAATTGGCAGAAAGTACAAAAAAGTCAGGTTTATGGCTTATA<br>CTGATGAGACTTTCAAAACTAGAGAGGCTATTCAACATGAATCTGGCATCCTAGGTCCTTTGTTATATGGGGAAGTAGG<br>GGACACCTTATTAATTATATTTAAAAACCAGGCCAGTAGGCCTTACAACATTTACCCCCACGGTATAACAGATGTCAGAC<br>CACTGTACTCAAGGAGGCTACCAAAAGGGGTGAAGCACCTAAAAGACTTCCCCATCCTACCTGGTGAGATTTTCAAGTA<br>TAAGTGGACAGTGACTGTAGAAGATGGTCCAACCAAATCAGATCCCAGATGCCTGACAAGGTACTACAGTAGCTTTGTA<br>AATATGGAGAGAGACCTGGCCTCAGGGTTAATAGGGCCCCTACTGATCTGCTACAAGGAGAGTGTAGACCAAAGAGGC<br>AACCAAATTATGTCAGACAAGAGAAATGTCATCCTCTTTAGTGTTTTTGATGAGAATAGGTCCTGGTACCTGACAGAAAA<br>TATCCAAAGATTCCTTCCAAATCCAGCAGGGGTACAACTGGAGGACCCTGAGTTCCAGGCCTCCAATATCATGCACAGC<br>ATCAATGGTTATGTGTTTGACAGTTTGCAACTTTCAGTGTGCCTTCATGAGGTTGCATACTGGTATATACTTTCTATAGGG<br>GCCCAGACAGACTTCTTGTCAGTTTTCTTTTCAGGCTATACTTTCAAGCATAAGATGGTATATGAAGATACCCTGACTCTT<br>TTTCCCTTTAGTGGTGAGACAGTTTTCATGTCAATGGAAAACCCAGGGCTTTGGATCTTGGGATGCCACAACTCTGACTT<br>TAGAAACAGAGGCATGACTGCCCTTTTAAAGGTGTCCTCTTGTGATAAGAATACTGGAGACTACTATGAGGACAGCTAT<br>GAGGACATTTCAGCCTATCTGCTGTCAAAAAATAATGCTATAGAGCCAAGGTCATTTTCTCAAAATCCTCCTGTCCTGAA<br>GAGGCACCAAAGAGAGATAACCAGGACTACCTTACAGTCTGACCAGGAGGAAATTGATTATGATGACACAATAAGTGT<br>GGAGATGAAAAAGGAGGATTTTGATATTTATGATGAGGATGAAAACCAATCTCCAAGATCTTTCCAGAAGAAGACTAG<br>ACACTATTTCATTGCTGCAGTGGAAAGACTGTGGGACTATGGAATGTCCTCCAGCCCTCATGTTCTCAGGAATAGGGCTC<br>AAAGTGGTTCTGTGCCACAGTTCAAGAAGGTGGTGTTTCAGGAATTCACAGATGGGTCCTTTACTCAACCACTGTATAG<br>GGGAGAACTCAATGAACATCTAGGATTACTAGGTCCCTACATTAGAGCTGAGGTGGAGGACAATATCATGGTCACTTTC<br>AGGAACCAGGCATCTAGACCATACTCTTTTTACAGCTCCTTGATATCTTATGAAGAGGACCAGAGACAGGGTGCAGAAC<br>CCAGGAAGAACTTTGTGAAACCCAATGAGACCAAAACATACTTCTGGAAGGTCCAGCATCATATGGCTCCTACCAAGGA<br>TGAATTTGACTGCAAAGCCTGGGCTTACTTCTCAGATGTGGATTTGGAGAAAGATGTGCACAGTGGCTTGATTGGGCCT<br>CTTTTGGTATGTCATACCAACACCTTAAACCCTGCTCATGGAAGACAAGTAACAGTGCAAGAGTTTGCCCTCTTTTTCACT<br>ATATTTGATGAGACAAAAAGTTGGTACTTTACTGAGAATATGGAGAGGAACTGCAGGGCTCCCTGCAATATACAGATGG<br>AGGATCCTACTTTCAAGGAAAACTATAGGTTTCATGCCATTAATGGCTATATCATGGATACATTGCCTGGCTTAGTTATG<br>GCCCAGGATCAGAGAATCAGATGGTACCTCCTTAGTATGGGAAGCAATGAAAACATACATTCTATTCACTTCAGTGGAC<br>ATGTCTTTACTGTGAGAAAAAAGGAAGAGTACAAGATGGCACTGTACAATCTGTACCCTGGAGTGTTTGAGACAGTTGA<br>GATGCTGCCCAGCAAGGCTGGGATCTGGAGGGTAGAATGCCTGATGGAGAACACTTACATGCAGGTATGTCCACTCT<br>ATTCTTGGTCTATTCCAACAAGTGTCAGACCCCCCTAGGCATGGCATCTGGCCATATTAGAGATTTCCAGATAACTGCTTC<br>TGGTCAGTATGGCCAGTGGGCCCCCAAGCTGCTAGACTTCACTACAGTGGTTCAATAAATGCCTGGTCCACCAAGGAG |

TABLE 1-continued

Exemplary FVIII sequences for treatment of hemophilia A
Exemplary nucleic acid sequences encoding Factor VIII

| Description | Length | Ref-erence | CG Content | SEQ ID NO: | Sequence |
|---|---|---|---|---|---|
| | | | | | CCCTTCAGCTGGATTAAAGTGGACTTGCTAGCCCCCATGATCATTCATGGGATAAAAACACAGGGTGCCAGACAGAAAT<br>TTTCATCTCTGTACATCAGCCAGTTTATCATCATGTACAGTCTGGATGGCAAAAAATGGCAGACCTACAGAGGTAACTCT<br>ACAGGTACACTAATGGTATTTTTTGGCAATGTAGATTCATCAGGTATCAAGCATAATATCTTTAATCCTCCCATTATTGCC<br>AGATACATCAGGTTGCACCCAACTCATTACAGTATAAGATCCACTTTAAGGATGGAGCTTATGGGGTGTGACCTTAATA<br>GCTGCAGTATGCCCTTGGGAATGGAAAGTAAGGCCATATCAGATGCCCAGATTACTGCAAGCAGCTACTTTACAAACAT<br>GTTTGCAACCTGGTCTCCTAGTAAAGCCAGGCTGCACTTGCAGGGTAGGAGCAATGCATGGAGACCCCAGGTCAATAAC<br>CCAAAAGAGTGGCTTCAAGTTGACTTTCAAAAGACAATGAAGGTAACAGGGGTAACCACCCAAGGGGTAAAGAGTCTG<br>CTGACATCTATGTATGTAAAAGAATTCCTCATCTCAAGTAGTCAAGATGGGCACCAGTGGACACTGTTCTTCCAGAATGG<br>AAAAGTTAAGGTGTTCCAAGGTAATCAAGACAGCTTCACTCCAGTGGTGAACAGTCTGGATCCACCACTCCTAACCAGG<br>TACCTGAGGATCCACCCTCAGTCCTGGGTCCACCAGATAGCTCTGAGAATGGAAGTGCTGGGCTGTGAAGCTCAGGACC<br>TATACTGA |
| CpG-free human hFVIII Full Length COOL optimized | 7056 | | 0 | 394 | ATGCAAATTGAATTGAGTACCTGTTTTTTCCTCTGTCTATTAAGGTTTTGTTTCAGTGCAACAAGAAGGTATTATCTGGGA<br>GCTGTTGAGTTATCCTGGGACTACATGCAGTCTGACCTGGGAGAGCTCCCAGTGGATGCTAGGTTTCCCCCAAGAGTAC<br>CCAAAAGCTTCCCTTTCAACACTTCTGTTGTCTATAAAAAGACTCTGTTTGTAGAATTCACAGATCATCTGTTTAACATTGC<br>CAAGCCTAGACCTCCATGGATGGGGCTGCTGGGACCAACTATTCAGGCAGAGGTTTATGACACTGTGGTGATTACACTT<br>AAGAATATGGCATCCCACCCAGTGAGCCTGCATGCTGTTGGGGTTTCCTACTGGAAGGCAAGTGAAGGAGCTGAGTAT<br>GATGACCAGACTAGCCAAAGAGAGAAGGAGGATGACAAGGTCTTTCCAGGTGGCAGCCACACCTATGTCTGGCAGGTG<br>CTGAAGGAGAATGGCCCTATGGCCTCTGATCCTTTGTGTCTAACCTACAGTTATTTGTCTCATGTGGACCTGGTGAAGGA<br>CCTTAACTCAGGGCTGATAGGGGCCTTGCTGGTGTGTAGGGAGGGAAGCCTGGCTAAGGAAAAGACACAGACTCTGCA<br>TAAGTTTATTCTCTTGTTTGCAGTGTTTGATGAGGGTAAAAGCTGGCACTCTGAAACAAAAAACAGCTGATGCAGGAC<br>AGGGATGCTGCCAGTGCTAGGGCTGGCCTAAGATGCACACAGTCAATGGCTATGTTAACAGATCACTGCCTGGTTTGA<br>TTGGCTGCCACAGAAAGTCTGTTTACTGGCATGTAATTGGGATGGGGACAACCCCAGAAGTTCACTCTATCTTCCTGGA<br>AGGGCACACCTTCCTGGTTAGAAATCATAGACAGGCATCCTTAGAGATTTCTCCTATTACATTCCTGACTGCCCAGACCC<br>TCCTCATGGACCTGGGTCAGTTCCTGCTTTTTTGCCACATTTCCTCCCACCAGCATGATGGCATGGAGGCCTATGTGAAA<br>GTTGATTCTTGCCCTGAGGAGCCTCAGCTTAGGATGAAGAACAATGAAGAGGCTGAGGACTATGATGATGACCTAACA<br>GACAGTGAGATGGATGTTGTGAGGTTTGATGATGACAATTCACCTAGTTTCATCCAGATTAGGTCTGTGGCTAAGAAAC<br>ATCCAAAGACCTGGGTTCACTACATTGCAGCAGAGGAGGAGGACTGGGATTATGCCCCCCTGGTTCTGGCACCTGATGA<br>CAGAAGCTATAAGTCCCAGTATCTCAACAATGGCCCCCAGAGGATTGGAAGAAAATACAAAAAAGTCAGATTTATGGCC<br>TATACAGATGAGACTTTTAAAACTAGGGAAGCTATTCAGCATGAGTCAGGGATCCTGGGACCTCTTCTTTATGGAGAGG<br>TGGGGGACACTCTTCTGATAATTTTTAAAAATCAGGCAAGTAGACCTTATAACATCTACCCCCATGGGATCACTGATGTC<br>AGGCCTCTGTACTCAAGAAGGCTGCCCAAGGGTGTCAAACACCTCAAGGATTTCCCTATTCTTCCTGGGGAGATCTTCAA<br>ATACAAGTGGACAGTTACTGTGGAGGATGGCCCCACCAAATCTGACCCAAGGTGCCTCACCAGATATTACAGCTCCTTT<br>GTGAATATGGAAAGAGACCTAGCTAGTGGTCTCATTGGCCCACTGCTCATCTGTTACAAGGAGTCAGTGGACCAGAGA<br>GGGAATCAAATTATGTCTGACAAGAGAAATGTGATCCTTTTCTCAGTGTTTGATGAGAACAGAAGCTGGTATCTGACAG<br>AGAACATTCAAAGGTTTCTGCCAAACCCAGCTGGAGTTCAGCTGGAGGACCCTGAATTCCAGGCATCTAATATTATGCAT<br>TCTATCAATGGATATGTGTTTGATAGTCTGCAGCTGTCTGTGTGCCTGCATGAAGTGGCCTACTGGTATATCCTCTCTATT<br>GGTGCCCAGACAGATTTCTTGTCTGTGTTTTTCAGTGGTTACACATTTAAACATAAAATGGTGTATGAGGACACACTTAC<br>ATTATTCCCTTTTAGTGGAGAGACAGTGTTTATGTCCATGGAGAATCCAGGCCTGTGGATCTTGGGGTGTCATAATAGTG<br>ACTTTAGGAATAGAGGTATGACAGCTCTGCTCAAAGTGTCTTCCTGTGACAAGAACACAGGGGACTATTATGAGGACTC<br>TTATGAGGACATTTCAGCCTATTTACTGTCCAAGAACAATGCCATTGAACCAAGATCTTTCTCTCAGAACTCAAGACACCC<br>CAGCACCAGGCAGAAGCAGTTCAATGCAACCACCATCCCAGAGAATGATATTGAAAAAACTGACCCTTGGTTTGCCCAC<br>AGGACTCCCATGCCTAAGATTCAGAATGTATCTTCATCAGACTTGCTGATGCTCCTGAGACAGAGCCCAACTCCTCATGG<br>CCTGAGCTTAAGTGACCTCCAGGAGGCTAAGTATGAAACTTTCTCAGATGATCCCAGTCCTGGTGCCATTGATTCTAATA<br>ATTCCCTGTCTGAGATGACACACTTCAGACCCCAGCTCCACCACTCTGGAGATATGGTCTTTACTCCTGAATCAGGCCTG<br>CAGCTGAGGCTGAATGAAAAGCTGGCACCACAGCAGCTACTGAACTGAAAAAGCTGGATTTTAAAGTGAGCTCCACAT |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | CCAACAACCTGATTTCCACTATCCCCTCAGATAACTTGGCAGCAGGGACTGATAACACAAGCTCACTGGGTCCCCCTTCC |
| | | | | | ATGCCTGTCCATTATGATAGTCAGCTGGATACTACTCTGTTTGGTAAGAAATCCTCTCCCCTGACTGAAAGTGGAGGCCC |
| | | | | | TCTTTCCCTGTCAGAGGAGAACAATGACAGCAAACTGTTAGAGTCTGGACTCATGAACTCACAGGAAAGTTCTTGGGGC |
| | | | | | AAGAATGTGTCTAGCACTGAGTCTGGGAGACTGTTTAAGGGCAAGAGGGCCCATGGACCAGCCCTGCTGACAAAGGAT |
| | | | | | AATGCACTGTTTAAGGTCTCAATCAGCCTGTTGAAGACCAACAAAACCAGTAATAATTCTGCAACAAACAGGAAGACCC |
| | | | | | ACATTGATGGACCCTCTCTTCTCATTGAGAATTCCCCTTCTGTCTGGCAGAACATCTTGGAATCAGATACAGAGTTCAAG |
| | | | | | AAGGTGACTCCCCTGATCCATGATAGGATGCTCATGGATAAGAATGCCACAGCACTCAGGCTCAATCACATGAGCAACA |
| | | | | | AGACTACCTCCTCCAAAAATATGGAGATGGTGCAGCAGAAGAAGGAAGGTCCCATTCCCCCTGATGCACAGAATCCAG |
| | | | | | ATATGAGCTTCTTTAAGATGCTGTTTTTCCTGAGTCTGCCAGGTGGATTCAGAGGACACATGGGAAGAACTCACTTAAC |
| | | | | | TCTGGCCAAGGTCCCAGTCCTAAGCAGTTGGTGAGCTGGGGCCTGAGAAAAGTGTGGAGGGACAGAATTTCCTGTCT |
| | | | | | GAAAAGAACAAAGTGGTTGTGGGCAAAGGAGAGTTCACTAAAGATGTGGGACTGAAGGAGATGGTGTTTCCTAGTTCA |
| | | | | | AGAAATCTCTTTCTTACCAATCTTGATAACCTGCATGAGAACAACACCCACAATCAGGAAAAGAAGATCCAGGAGGAAA |
| | | | | | TTGAGAAGAAGGAAACCCTGATCCAGGAAAATGTTGTGCTGCCACAGATCCACACTGTTACTGGGACCAAAAATTTCAT |
| | | | | | GAAAAACCTGTTTCTCCTGTCTACCAGACAGAATGTAGAGGGAAGCTATGATGGGGCCTATGCCCCTGTTCTCCAGGAC |
| | | | | | TTCAGATCCCTGAATGACTCCACCAACAGGACTAAGAAACATACTGCACACTTTAGTAAGAAGGGGGAGGAGGAGAAC |
| | | | | | CTGGAGGGATTGGGAAACCAGACCAAGCAGATTGTGGAGAAATATGCTGCACCACTAGAATCTCACCTAACACAAGC |
| | | | | | CAGCAGAACTTTGTGACCCAGAGGTCTAAGAGGGCCCTCAAACAGTTTAGATTGCCTTTGGAGGAGACTGAGCTGGAA |
| | | | | | AAGAGGATTATTGTGGATGACACCTCTACCCAGTGGAGCAAGAATATGAAGCACCTGACCCCAAGCACCCTTACTCAGA |
| | | | | | TTGATTACAATGAAAAAGAAAAGGGTGCCATCACCCAGAGCCCCTTGAGTGACTGTTTGACAAGGTCCCACAGTATCCC |
| | | | | | ACAGGCTAACAGATCTCCTCTGCCTATTGCCAAGGTCAGCTCCTTCCCTTCCATCAGACCCATCTATCTGACCAGAGTGCT |
| | | | | | GTTCCAGGACAACTCCTCTCATCTGCCAGCTGCCTCCTATAGGAAGAAGGATAGTGGTGTGCAGGAATCATCTCACTTTC |
| | | | | | TGCAGGGAGCCAAGAAGAACAATCTGAGCCTGGCAATTCTCACACTTGAGATGACAGGAGACCAGAGGGAAGTGGGA |
| | | | | | AGTCTGGGCACTTCTGCTACCAATTCTGTCACCTACAAGAAAGTGGAGAATACAGTTCTGCCCAAGCCAGACCTGCCTAA |
| | | | | | AACATCTGGAAAGGTTGAGCTGCTGCCTAAGGTGCACATATACCAGAAGGACCTATTCCCTACAGAGACATCCAATGGC |
| | | | | | TCCCCAGGCCACCTGGACTTGGTAGAGGGGTCTCTCCTGCAGGGCACTGAAGGTGCTATCAAGTGGAATGAGGCTAAT |
| | | | | | AGACCTGGGAAGGTGCCATTTCTGAGGGTGGCCACAGAGAGCTCAGCTAAGACACCCAGCAAGCTGCTTGATCCCCTG |
| | | | | | GCCTGGGACAATCACTATGGAACCCAGATTCCTAAGGAGGAGTGGAAGTCCCAGGAGAAGTCCCCAGAGAAGACTGCT |
| | | | | | TTCAAGAAGAAGGACACTATCCTCTCCCTGAATGCCTGTGAGTCTAACCATGCTATTGCTGCCATCAATGAAGGCCAGAA |
| | | | | | CAAGCCTGAAATTGAGGTGACATGGGCCAAGCAGGGCAGAACAGAGAGGCTGTGCAGCCAGAACCCACCTGTGCTCA |
| | | | | | AGAGGCACCAGAGAGAGATCACTAGAACCACTCTGCAGTCAGACCAGGAAGAGATTGACTATGATGACACCATCTCAG |
| | | | | | TTGAGATGAAAAAGGAGGATTTTGATATTTATGATGAGGATGAGAATCAATCCCCAAGATCTTTTCAGAAGAAGACAAG |
| | | | | | ACATTACTTCATTGCTGCAGTGGAGAGACTGTGGGATTATGGCATGTCCTCCTCACCTCATGTGCTGAGAAATAGAGCCC |
| | | | | | AGTCTGGCTCTGTGCCCCAGTTCAAAAAAGTGGTGTTTCAGGAGTTCACAGATGGTTCCTTCACACAGCCCCTGTACAGG |
| | | | | | GGTGAGCTGAATGAGCACCTGGGGTTGCTGGGCCCCTACATCAGAGCTGAAGTTGAGGATAATATTATGGTGACCTTC |
| | | | | | AGGAATCAGGCCAGTAGGCCTTACTCTTTCTACTCCAGCCTGATCTCATATGAGGAGGACCAGAGACAGGGGGCTGAAC |
| | | | | | CTAGGAAGAATTTTGTGAAGCCCAATGAAACAAAGACATACTTCTGGAAGGTGCAGCACCACATGGCTCCTACCAAGGA |
| | | | | | TGAATTTGATTGCAAGGCTTGGGCCTATTTTTCTGATGTGGACCTGGAGAAGGATGTGCATTCTGGCCTCATTGGCCCTC |
| | | | | | TCTTGGTGTGTCACACCAATACCTTGAATCCAGCCCATGGCAGACAGGTGACTGTTCAGGAGTTTGCTCTGTTTTTCACC |
| | | | | | ATCTTTGATGAGACAAAGTCCTGGTATTTTACAGAGAATATGGAGAGGAATTGCAGGGCCCCCTGCAACATCCAGATGG |
| | | | | | AAGACCCAACCTTCAAGGAGAACTACAGATTCCATGCAATCAATGGATATATCATGGACACCCTGCCTGGCCTGGTTAT |
| | | | | | GGCTCAGGATCAGAGAATCAGGTGGTATCTGCTGTCTATGGGGTCAAATGAGAACATCCATAGTATCCACTTCTCTGGC |
| | | | | | CATGTGTTTACAGTGAGAAAGAAGGAAGAATATAAGATGGCCCTGTACAACCTCTACCCTGGAGTGTTTGAAACTGTTG |
| | | | | | AAATGCTGCCTTCAAAGGCTGGAATCTGGAGGGTGGAATGCCTGATTGGAGAGCACCTTCATGCTGGCATGTCCACCCT |
| | | | | | GTTTCTGGTGTACAGCAATAAGTGTCAGACTCCTCTGGGTATGGCTTCAGGCCACATCAGGGACTTCCAGATCACTGCCT |
| | | | | | CAGGACAGTATGGACAGTGGGCTCCCAAACTGGCAAGGCTCCACTACTCAGGCAGCATTAATGCCTGGTCCACCAAAG |
| | | | | | AGCCTTTCAGCTGGATTAAGGTGGATCTCCTGGCACCTATGATCATCCATGGGATCAAGACTCAGGGAGCTAGGCAGAA |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | GTTTAGCAGCCTGTACATTTCTCAGTTTATCATTATGTACAGCCTGGATGGAAAAAGTGGCAGACCTATAGAGGAAACT<br>CCACTGGAACACTGATGGTGTTTTTGGCAATGTGGACTCAAGTGGGATCAAGCACAATATCTTCAACCCCCCTATCATT<br>GCCAGATACATCAGGCTCCACCCTACACACTACTCTATCAGATCTACACTTAGGATGGAGCTGATGGGATGTGATCTGAA<br>CTCTTGCAGTATGCCTCTGGGTATGGAGTCCAAGGCCATCTCTGATGCTCAGATCACAGCCAGCTCTTACTTTACTAATAT<br>GTTTGCTACCTGGTCCCCAAGCAAGGCAAGACTGCACCTGCAGGGCAGATCCAATGCTTGGAGACCCCAGGTGAATAAC<br>CCAAAAGAGTGGCTTCAGGTGGACTTCCAGAAGACTATGAAGGTGACTGGAGTGACCACCCAGGGGGTGAAGTCACTG<br>CTGACCTCCATGTATGTGAAGGAGTTCCTGATCTCCAGCTCCCAGGATGGCCACCAGTGGACCCTGTTCTTCCAGAATGG<br>AAAGGTGAAGGTGTTCCAGGGAAACCAGGACTCCTTTACCCCTGTGGTGAACTCCCTGGACCCCCCACTGCTGACCAGA<br>TACCTGAGAATCCATCCCCAGAGCTGGGTGCACCAGATTGCCCTTAGGATGGAGGTGCTGGGATGTGAAGCCCAGGAC<br>CTGTACTAA |
| CpG-free human hFVIII 226 Variant COOL optimized | 5013 | https://www.ncbi.nLm.nih.gov/pubmed/14726380 | 0 | 395 | ATGCAAATTGAGTTAAGTACCTGTTTTTTCCTGTGCCTGTTGAGATTTTGCTTCTCTGCTACCAGAAGGTATTACCTGGGA<br>GCTGTGGAGCTGTCATGGGACTACATGCAGTCTGACCTGGGAGAGCTCCCTGTTGATGCTAGGTTTCCCCCTAGGGTGC<br>CAAAGTCCTTTCCTTTTAACACCTCAGTGGTGTACAAGAAGACACTGTTTGTGGAGTTTACTGACCACCTCTTCAATATTG<br>CTAAGCCAAGACCCCCTTGGATGGGTCTCTTGGGCCCTACCATCCAGGCTGAGGTTTATGATACAGTGGTGATTACCCTC<br>AAGAATATGGCTTCTCATCCTGTTAGTCTGCATGCAGTAGGGGTCAGCTATTGGAAGGCCAGTGAAGGAGCTGAGTAT<br>GATGACCAGACCAGCCAGAGAGAGAAAGAGGATGACAAGGTGTTCCCTGGGGGATCACACACCTATGTGTGGCAGGT<br>GTTGAAGGAAAATGGACCCATGGCCTCTGACCCACTCTGCCTGACTTACTCCTACCTGTCTCATGTGGACCTGGTCAAAG<br>ATCTGAACTCTGGCCTGATTGGGGCACTGTTGGTGTGCAGAGAAGGGTCTCTTGCCAAGGAGAAGACTCAGACCCTGC<br>ACAAGTTCATCCTGCTGTTTGCTGTGTTTGATGAAGGCAAGTCTTGGCATTCTGAGACTAAGAACAGCCTGATGCAAGAT<br>AGAGATGCTGCATCTGCCAGGGCCTGGCCTAAGATGCACACTGTGAATGGATATGTGAATAGGTCCTTGCCTGGCCTGA<br>TTGGATGCCATAGGAAGTCTGTGTACTGGCATGTGATTGGCATGGGCACCACCCCTGAGGTTCACTCTATTTTTCTGGAG<br>GGCCATACTTTCCTTGTGAGGAATCATAGACAGGCCTCTCTGGAGATTAGCCCTATTACATTTCTGACTGCTCAGACCCTC<br>CTCATGGACTTGGGGCAGTTTCTGTTATTCTGCCACATCAGCAGCCATCAACATGATGGTATGGAAGCCTATGTCAAAGT<br>GGATAGCTGCCCTGAAGAACCACAGCTTAGGATGAAGAACAATGAGGAGGCAGAGGACTATGATGATGATCTGACTG<br>ATTCTGAAATGGATGTGGTGAGATTTGATGATGATAATAGCCCTTCCTTTATCCAGATCAGGTCAGTGGCCAAGAAGCA<br>CCCAAAGACCTGGGTGCATTATATTGCTGCTGAGGAGGAGGACTGGGACTATGCCCCTCTGGTGCTGGCCCCTGATGAT<br>AGAAGCTATAAGTCTCAATACTTGAATAATGGCCCACAGAGGATTGGGAGAAAGTACAAAAAGGTGAGATTTATGGCC<br>TACACTGATGAGACTTTCAAGACCAGAGAGGCCATCCAGCATGAATCAGGCATTTTGGGTCCCCTGCTGTATGGAGAGG<br>TGGGGGATACCCTGCTGATCATCTTTAAGAACCAGGCCAGCAGACCTTACAACATTTACCCTCATGGGATCACAGATGT<br>GAGGCCACTCTACTCTAGGAGATTGCCCAAGGGAGTCAAGCATCTTAAGGACTTTCCAATCCTGCCTGGGGAGATCTTC<br>AAGTACAAATGGACAGTGACAGTTGAGGATGGACCTACTAAGAGTGACCCCAGGTGTCTGACCAGATATTACTCTAGCT<br>TTGTCAATATGGAAAGAGACCTGGCTTCAGGCTTGATAGGCCCTCTTCTCATCTGCTACAAAGAGTCTGTGGACCAGAG<br>AGGAAATCAGATTATGTCTGACAAGAGAAATGTTATTCTGTTTTCAGTCTTTGATGAGAACAGAAGTTGGTACTTGACAG<br>AGAACATTCAGAGATTTCTGCCTAACCCTGCAGGAGTGCAGCTTGAGGACCCTGAGTTTCAGGCTTCCAATATCATGCAT<br>TCTATCAATGGCTATGTGTTTGATAGCCTGCAGCTGTCTGTGTGCCTGCATGAGGTTGCCTATTGGTACATCCTGTCTATT<br>GGGGCCCAAACTGATTTCTTGTCTGTGTTTTTCAGTGGATATACCTTTAAGCATAAGATGGTGTATGAAGATACCTTGAC<br>ACTTTTCCCTTTCTCAGGAGAGACTGTCTTCATGTCTATGGAGAACCCTGGACTGTGGATCCTGGGATGCCACAACTCAG<br>ACTTCAGAAACAGGGGTATGACAGCTCTGCTTAAGGTCTCCTCATGTGACAAAAATACAGGAGACTACTATGAAGATTC<br>CTATGAGGACATCTCTGCTTACCTGCTCAGCAAAAACAATGCCATTGAGCCCAGAAGCTTCAGCCAGAATTCCAGACATC<br>CCAGTACTAGGCAGAAGCAGTTTAATGCCACCACCATCCCAGAAAATGACATTGAGAAGACAGACCCTTGGTTTGCCCA<br>TAGAACCCCAATGCCCAAGATTCAGAATGTGAGCAGCTCAGACTTGCTGATGCTGCTGAGGCAGTCTCCTACTCCCCATG<br>GCCTGTCCCTCTCAGATCTGCAGGAAGCCAAGTATGAGACATTTTCTGATGACCCCTCCCCAGGGGCTATTGACAGTAAC<br>AACAGCCTGTCTGAAATGACCCACTTCAGACCTCAGCTCCACCACAGTGGGGATATGGTGTTTACCCCAGAGTCAGGCC<br>TGCAGCTGAGACTGAATGAGAAGCTGGGAACCACAGCTGCCACAGAACTGAAGAAGCTGGATTTCAAGGTGAGCTCTA<br>CTTCAAATAATCTGATTTCCACTATCCCATCTGACAATTTGGCAGCTGGCACTGACAATACAAGCTCTCTGGGCCCACCTA |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | GCATGCCAGTGCATTATGACAGCCAGTTGGACACCACTCTTTTTGGAAAGAAATCCAGTCCCCTGACAGAGTCAGGAGG<br>ACCCCTTTCTCTGTCTGAGGAGAACAATGATAGTAAGCTTCTGGAGTCAGGCTTGATGAACTCCCAGGAGAGTTCTTGG<br>GGCAAGAATGTGAGCTCTAGGGAGATCACCAGAACCACTCTGCAGTCTGACCAAGAAGAGATTGATTATGATGACACT<br>ATCTCTGTTGAGATGAAGAAGGAGGACTTTGATATCTATGATGAGGATGAGAACCAGTCTCCAAGAAGTTTCCAGAAGA<br>AGACCAGGCACTACTTTATTGCTGCTGTGGAGAGACTGTGGGACTATGGAATGTCCTCCTCCCCTCATGTCCTGAGAAAT<br>AGAGCTCAGTCAGGATCAGTGCCCCAGTTCAAGAAGGTGGTGTTCCAGGAATTCACAGATGGAAGTTTTACCCAGCCAC<br>TGTATAGAGGTGAACTGAATGAACATCTGGGTCTGCTGGGGCCCTATATCAGGGCTGAGGTGGAGGACAATATTATGG<br>TGACCTTTAGAAACCAGGCCTCAAGGCCCTACAGCTTCTACTCTTCCCTCATTTCATATGAGGAAGACCAGAGACAGGGA<br>GCAGAGCCTAGAAAGAACTTTGTCAAGCCCAATGAAACCAAAACCTATTTCTGGAAGGTGCAGCACCACATGGCACCCA<br>CCAAAGATGAGTTTGACTGCAAAGCCTGGGCCTATTTCTCAGATGTGGATCTGGAGAAGGATGTCCATTCAGGTCTGAT<br>TGGACCACTCCTGGTGTGCCACACCAACACACTGAATCCAGCTCATGGCAGACAGGTGACAGTCCAGGAGTTTGCCCTG<br>TTTTTCACTATTTTTGATGAGACCAAGAGCTGGTATTTTACAGAGAATATGGAAAGAAACTGCAGAGCCCCTTGTAATAT<br>CCAGATGGAGGACCCAACCTTTAAGGAGAACTACAGGTTCCATGCCATCAATGGCTACATTATGGATACCCTGCCTGGC<br>CTGGTTATGGCCCAGGATCAGAGGATCAGGTGGTATCTGCTGTCAATGGGCTCCAATGAGAACATTCATAGTATTCACT<br>TTTCAGGACATGTGTTCACAGTGAGAAAGAAGGAGGAGTATAAGATGGCCCTCTATAATCTCTACCCAGGGGTGTTTGA<br>GACAGTTGAGATGCTGCCATCTAAGGCAGGCATCTGGAGAGTGGAATGCCTCATTGGAGAGCACCTGCATGCTGGCAT<br>GTCCACCCTGTTTCTGGTGTACTCCAACAAATGTCAGACCCCTCTTGGTATGGCCTCTGGCCACATTAGGGATTTCCAGAT<br>TACTGCCAGTGGTCAGTATGGGCAGTGGGCCCCTAAGCTGGCCAGACTGCACTATTCTGGGAGCATCAATGCCTGGTCC<br>ACCAAGGAACCTTTTTCTTGGATTAAAGTGGATCTGCTGGCCCCAATGATCATCCATGGGATCAAGACCCAGGGAGCTA<br>GGCAGAAGTTCAGCAGCCTGTACATTAGTCAGTTCATCATTATGTACAGTCTGGATGGCAAAAAGTGGCAGACATACAG<br>GGGCAATTCCACTGGAACCCTGATGGTGTTCTTTGGAAATGTGGATAGCAGTGGTATCAAGCACAACATTTTCAACCCTC<br>CCATCATTGCCAGGTACATCAGACTGCATCCAACCCACTACAGCATTAGGAGCACCCTTAGGATGGAGCTCATGGGGTG<br>TGACCTGAACTCTTGCTCTATGCCACTTGGAATGGAGAGCAAGGCCATCTCTGATGCCCAGATTACTGCTAGTTCCTACT<br>TCACCAATATGTTTGCCACCTGGTCACCCAGCAAGGCCAGGCTGCACCTGCAGGGAAGGTCCAATGCTGGAGGCCTCA<br>GGTGAACAATCCAAAGGAGTGGCTGCAGGTGGACTTCCAGAAGACTATGAAGGTGACAGGAGTGACCACTCAGGGAG<br>TGAAGAGCCTGCTGACCTCCATGTATGTGAAGGAGTTTCTGATCTCCAGCTCCCAGGATGGCCACCAGTGGACCCTGTT<br>CTTTCAGAATGGCAAGGTGAAGGTGTTTCAGGGGAATCAGGACTCCTTCACCCCAGTGGTGAATTCCCTGGATCCCCCT<br>CTGCTGACCAGATACCTGAGAATCCACCCCCAGTCTTGGGTGCACCAGATTGCCCTTAGGATGGAGGTGCTGGGCTGTG<br>AGGCCCAGGACCTGTACTGA |
| CpG-free human hFVIII 226 Variant with F309S Mutation; COOL optimized | 5013 | https://www.ncbi.nlm.nih.gov/pubmed/14726380 | 0 | 396 | ATGCAAATTGAGTTAAGTACCTGTTTTTCCTGTGCCTGTTGAGATTTTGCTTCTCTGCTACCAGAAGGTATTACCTGGGA<br>GCTGTGGAGCTGTCATGGGACTACATGCAGTCTGACCTGGGAGAGCTCCCTGTTGATGCTAGGTTTCCCCCTAGGGTGC<br>CAAAGTCCTTTCCTTTTAACACCTCAGTGGTGTACAAGAAGACACTGTTTGTGGAGTTTACTGACCACCTCTTCAATATTG<br>CTAAGCCAAGACCCCCTTGGATGGGTCTCTTGGGCCCTACCATCCAGGCTGAGGTTTATGATACAGTGGTGATTACCCTC<br>AAGAATATGGCTTCTCATCCTGTTAGTCTGCATGCAGTAGGGGTCAGCTATTGGAAGGCCAGTGAAGGAGCTGAGTAT<br>GATGACCAGACCAGCCAGAGAGAGAAAGAGGATGACAAGGTGTTCCCTGGGGGATCACACACCTATGTGTGGCAGGT<br>GTTGAAGGAAAATGGACCCATGGCCTCTGACCCACTCTGCCTGACTTACTCCTACCTGTCTCATGTGGACCTGGTCAAAG<br>ATCTGAACTCTGGCCTGATTGGGGCACTGTTGGTGTGCAGAGAAGGGTCTCTTGCCAAGGAGAAGACTCAGACCCTGC<br>ACAAGTTCATCCTGCTGTTTGCTGTGTTTGATGAAGGCAAGTCTTGGCATTCTGAGACTAAGAACAGCCTGATGCAAGAT<br>AGAGATGCTGCATCTGCCAGGGCCTGGCCTAAGATGCACACTGTGAATGGATATGTGAATAGGTCCTTGCCTGGCCTGA<br>TTGGATGCCATAGGAAGTCTGTGTACTGGCATGTGATTGGCATGGGCACCACCCCTGAGGTTCACTCTATTTTTCTGGAG<br>GGCCATACTTTCCTTGTGAGGAATCATAGACAGGCCTCTCTGGAGATTAGCCCTATTACATTTCTGACTGCTCAGACCCTC<br>CTCATGGACTTGGGGCAGTTTCTGTTAAGCTGCCACATCAGCAGCCATCAACATGATGGTATGGAAGCCTATGTCAAAG<br>TGGATAGCTGCCCTGAAGAACCACAGCTTAGGATGAAGAACAATGAGGAGGCAGAGGACTATGATGATGATCTGACTG<br>ATTCTGAAATGGATGTGGTGAGATTTGATGATGATAATAGCCCTTCCTTTATCCAGATCAGGTCAGTGGCCAAGAAGCA<br>CCCAAAGACCTGGGTGCATTATATTGCTGCTGAGGAGGAGGACTGGGACTATGCCCCTCTGGTGCTGGCCCCTGATGAT |

TABLE 1-continued

Exemplary FVIII sequences for treatment of hemophilia A
Exemplary nucleic acid sequences encoding Factor VIII

| Description | Length | Reference | CG Content | SEQ ID NO: | Sequence |
|---|---|---|---|---|---|
| | | | | | AGAAGCTATAAGTCTCAATACTTGAATAATGGCCCACAGAGGATTGGGAGAAAGTACAAAAAGGTGAGATTTATGGCC |
| | | | | | TACACTGATGAGACTTTCAAGACCAGAGAGGCCATCCAGCATGAATCAGGCATTTTGGGTCCCCTGCTGTATGGAGAGG |
| | | | | | TGGGGGATACCCTGCTGATCATCTTTAAGAACCAGGCCAGCAGACCTTACAACATTTACCCTCATGGGATCACAGATGT |
| | | | | | GAGGCCACTCTACTCTAGGAGATTGCCCAAGGGAGTCAAGCATCTTAAGGACTTTCCAATCCTGCCTGGGGAGATCTTC |
| | | | | | AAGTACAAATGGACAGTGACAGTTGAGGATGGACCTACTAAGAGTGACCCCAGGTGTCTGACCAGATATTACTCTAGCT |
| | | | | | TTGTCAATATGGAAAGAGACCTGGCTTCAGGCTTGATAGGCCCTCTTCTCATCTGCTACAAAGAGTCTGTGGACCAGAG |
| | | | | | AGGAAATCAGATTATGTCTGACAAGAGAAATGTTATTCTGTTTTCAGTCTTTGATGAGAACAGAAGTTGGTACTTGACAG |
| | | | | | AGAACATTCAGAGATTTCTGCCTAACCCTGCAGGAGTGCAGCTTGAGGACCCTGAGTTTCAGGCTTCCAATATCATGCAT |
| | | | | | TCTATCAATGGCTATGTGTTTGATAGCCTGCAGCTGTCTGTGTGCCTGCATGAGGTTGCCTATTGGTACATCCTGTCTATT |
| | | | | | GGGGCCCAAACTGATTTCTTGTCTGTGTTTTTCAGTGGATATACCTTTAAGCATAAGATGGTGTATGAAGATACCTTGAC |
| | | | | | ACTTTTCCCTTTCTCAGGAGAGACTGTCTTCATGTCTATGGAGAACCCTGGACTGTGGATCCTGGGATGCCACAACTCAG |
| | | | | | ACTTCAGAAACAGGGGTATGACAGCTCTGCTTAAGGTCTCCTCATGTGACAAAAATACAGGAGACTACTATGAAGATTC |
| | | | | | CTATGAGGACATCTCTGCTTACCTGCTCAGCAAAAACAATGCCATTGAGCCCAGAAGCTTCAGCCAGAATTCCAGACATC |
| | | | | | CCAGTACTAGGCAGAAGCAGTTTAATGCCACCACCATCCCAGAAAATGACATTGAGAAGACAGACCCTTGGTTTGCCCA |
| | | | | | TAGAACCCCAATGCCCAAGATTCAGAATGTGAGCAGCTCAGACTTGCTGATGCTGCTGAGGCAGTCTCCTACTCCCCATG |
| | | | | | GCCTGTCCCTCTCAGATCTGCAGGAAGCCAAGTATGAGACATTTTCTGATGACCCCTCCCCAGGGGCTATTGACAGTAAC |
| | | | | | AACAGCCTGTCTGAAATGACCCACTTCAGACCTCAGCTCCACCACAGTGGGGATATGGTGTTTACCCCAGAGTCAGGCC |
| | | | | | TGCAGCTGAGACTGAATGAGAAGCTGGGAACCACAGCTGCCACAGAACTGAAGAAGCTGGATTTCAAGGTGAGCTCTA |
| | | | | | CTTCAAATAATCTGATTTCCACTATCCCATCTGACAATTTGGCAGCTGGCACTGACAATACAAGCTCTCTGGGCCCACCTA |
| | | | | | GCATGCCAGTGCATTATGACAGCCAGTTGGACACCACTCTTTTTGGAAAGAAATCCAGTCCCCTGACAGAGTCAGGAGG |
| | | | | | ACCCCTTTCTCTGTCTGAGGAGAACAATGATAGTAAGCTTCTGGAGTCAGGCTTGATGAACTCCCAGGAGAGTTCTTGG |
| | | | | | GGCAAGAATGTGAGCTCTAGGGAGATCACCAGAACCACTCTGCAGTCTGACCAAGAAGAGATTGATTATGATGACACT |
| | | | | | ATCTCTGTTGAGATGAAGAAGGAGGACTTTGATATCTATGATGAGGATGAGAACCAGTCTCCAAGAAGTTTCCAGAAGA |
| | | | | | AGACCAGGCACTACTTTATTGCTGCTGTGGAGAGACTGTGGGACTATGGAATGTCCTCCTCCCCTCATGTCCTGAGAAAT |
| | | | | | AGAGCTCAGTCAGGATCAGTGCCCCAGTTCAAGAAGGTGGTGTTCCAGGAATTCACAGATGGAAGTTTTACCCAGCCAC |
| | | | | | TGTATAGAGGTGAACTGAATGAACATCTGGGTCTGCTGGGGCCCTATATCAGGGCTGAGGTGGAGGACAATATTATGG |
| | | | | | TGACCTTTAGAAACCAGGCCTCAAGGCCCTACAGCTTCTACTCTTCCCTCATTTCATATGAGGAAGACCAGAGACAGGGA |
| | | | | | GCAGAGCCTAGAAAGAACTTTGTCAAGCCCAATGAAACCAAAACCTATTTCTGGAAGGTGCAGCACCACATGGCACCCA |
| | | | | | CCAAAGATGAGTTTGACTGCAAAGCCTGGGCCTATTTCTCAGATGTGGATCTGGAGAAGGATGTCCATTCAGGTCTGAT |
| | | | | | TGGACCACTCCTGGTGTGCCACACCAACACACTGAATCCAGCTCATGGCAGACAGGTGACAGTCCAGGAGTTTGCCCTG |
| | | | | | TTTTTCACTATTTTTGATGAGACCAAGAGCTGGTATTTTACAGAGAATATGGAAAGAAACTGCAGAGCCCCTTGTAATAT |
| | | | | | CCAGATGGAGGACCCAACCTTTAAGGAGAACTACAGGTTCCATGCCATCAATGGCTACATTATGGATACCCTGCCTGGC |
| | | | | | CTGGTTATGGCCCAGGATCAGAGGATCAGGTGGTATCTGCTGTCAATGGGCTCCAATGAGAACATTCATAGTATTCACT |
| | | | | | TTTCAGGACATGTGTTCACAGTGAGAAAGAAGGAGGAGTATAAGATGGCCCTCTATAATCTCTACCCAGGGGTGTTTGA |
| | | | | | GACAGTTGAGATGCTGCCATCTAAGGCAGGCATCTGGAGAGTGGAATGCCTCATTGGAGAGCACCTGCATGCTGGCAT |
| | | | | | GTCCACCCTGTTTCTGGTGTACTCCAACAAATGTCAGACCCCTCTTGGTATGGCCTCTGGCCACATTAGGGATTTCCAGAT |
| | | | | | TACTGCCAGTGGTCAGTATGGGCAGTGGGCCCCTAAGCTGGCCAGACTGCACTATTCTGGGAGCATCAATGCCTGGTCC |
| | | | | | ACCAAGGAACCTTTTTCTTGGATTAAAGTGGATCTGCTGGCCCCAATGATCATCCATGGGATCAAGACCCAGGGAGCTA |
| | | | | | GGCAGAAGTTCAGCAGCCTGTACATTAGTCAGTTCATCATTATGTACAGTCTGGATGGCAAAAAGTGGCAGACATACAG |
| | | | | | GGGCAATTCCACTGGAACCCTGATGGTGTTCTTTGGAAATGTGGATAGCAGTGGTATCAAGCACAACATTTTCAACCCTC |
| | | | | | CCATCATTGCCAGGTACATCAGACTGCATCCAACCCACTACAGCATTAGGAGCACCCTTAGGATGGAGCTCATGGGGTG |
| | | | | | TGACCTGAACTCTTGCTCTATGCCACTTGGAATGGAGAGCAAGGCCATCTCTGATGCCCAGATTACTGCTAGTTCCTACT |
| | | | | | TCACCAATATGTTTGCCACCTGGTCACCCAGCAAGGCCAGGCTGCACCTGCAGGGAAGGTCCAATGCTGGAGGCCTCA |
| | | | | | GGTGAACAATCCAAAGGAGTGGCTGCAGGTGGACTTCCAGAAGACTATGAAGGTGACAGGAGTGACCACTCAGGGAG |
| | | | | | TGAAGAGCCTGCTGACCTCCATGTATGTGAAGGAGTTTCTGATCTCCAGCTCCCAGGATGGCCACCAGTGGACCCTGTT |
| | | | | | CTTTCAGAATGGCAAGGTGAAGGTGTTTCAGGGGAATCAGGACTCCTTCACCCCAGTGGTGAATTCCCTGGATCCCCCT |

TABLE 1-continued

Exemplary FVIII sequences for treatment of hemophilia A
Exemplary nucleic acid sequences encoding Factor VIII

| Description | Length | Ref-erence | CG Content | SEQ ID NO: | Sequence |
|---|---|---|---|---|---|
| | | | | | CTGCTGACCAGATACCTGAGAATCCACCCCCAGTCTTGGGTGCACCAGATTGCCCTTAGGATGGAGGTGCTGGGCTGTG AGGCCCAGGACCTGTACTGA |
| CpG-free human hFVIII 226 Variant with F309S Mutation; COOL optimized-amino acid sequence | | | | 397 | MQIELSTCFFLCLLRFCFSATRRYYLGAVELSWDYMQSDLGELPVDARFPPRVPKSFPFNTSVVYKKTLFVEFTDHLFNIAKPRP PWMGLLGPTIQAEVYDTVVITLKNMASHPVSLHAVGVSYWKASEGAEYDDQTSQREKEDDKVFPGGSHTYVWQVLKENG PMASDPLCLTYSYLSHVDLVKDLNSGLIGALLVCREGSLAKEKTQTLHKFILLFAVFDEGKSWHSETKNSLMQDRDAASARAW PKMHTVNGYVNRSLPGLIGCHRKSVYWHVIGMGTTPEVHSIFLEGHTFLVRNHRQASLEISPITFLTAQTLLMDLGQFLLSCHI SSHQHDGMEAYVKVDSCPEEPQLRMKNNEEAEDYDDDLTDSEMDVVRFDDDNSPSFIQIRSVAKKHPKTWVHYIAAEEED WDYAPLVLAPDDRSYKSQYLNNGPQRIGRKYKKVRFMAYTDETFKTREAIQHESGILGPLLYGEVGDTLLIIFKNQASRPYNIYP HGITDVRPLYSRRLPKGVKHLKDFPILPGEIFKYKWTVTVEDGPTKSDPRCLTRYYSSFVNMERDLASGLIGPLLICYKESVDQR GNQIMSDKRNVILFSVFDENRSWYLTENIQRFLPNPAGVQLEDPEFQASNIMHSINGYVFDSLQLSVCLHEVAYWYILSIGAQ TDFLSVFFSGYTFKHKMVYEDTLTLFPFSGETVFMSMENPGLWILGCHNSDFRNRGMTALLKVSSCDKNTGDYYEDSYEDISA YLLSKNNAIEPRSFSQNSRHPSTRQKQFNATTIPENDIEKTDPWFAHRTPMPKIQNVSSSDLLMLLRQSPTPHGLSLSDLQEAK YETFSDDPSPGAIDSNNSLSEMTHFRPQLHHSGDMVFTPESGLQLRLNEKLGTTAATELKKLDFKVSSTSNNLISTIPSDNLAA GTDNTSSLGPPSMPVHYDSQLDTTLFGKKSSPLTESGGPLSLSEENNDSKLLESGLMNSQESSWGKNVSSREITRTTLQSDQE EIDYDDTISVEMKKEDFDIYDEDENQSPRSFQKKTRHYFIAAVERLWDYGMSSSPHVLRNRAQSGSVPQFKKVVFQEFTDGSF TQPLYRGELNEHLGLLGPYIRAEVEDNIMVTFRNQASRPYSFYSSLISYEEDQRQGAEPRKNFVKPNETKTYFWKVQHHMAP TKDEFDCKAWAYFSDVDLEKDVHSGLIGPLLVCHTNTLNPANGRQVTVQEFALFFTIFDETKSWYFTENMERNCRAPCNIQM EDPTFKENYRFHAINGYIMDTLPGLVMAQDQRIRWYLLSMGSNENIHSIHFSGHVFTVRKKEEYKMALYNLYPGVFETVEML PSKAGIWRVECLIGEHLHAGMSTLFLVYSNKCQTPLGMASGHIRDFQITASGQYGQWAPKLARLHYSGSINAWSTKEPFSWI KVDLLAPMIIHGIKTQGARQKFSSLYISQFIIMYSLDGKKWQTYRGNSTGTLMVFFGNVDSSGIKHNIFNPPIIARYIRLHPTHYS IRSTLRMELMGCDLNSCSMPLGMESKAISDAQITASSYFTNMFATWSPSKARLHLQGRSNAWRPQVNNPKEWLQVDFQKT MKVTGVITQGVKSLLTSMYVKEFLISSSQDGHQWTLFFQNGKVKVFQGNQDSFTPVVNSLDPPLLTRYLRIHPQSWVHQIAL RMEVLGCEAQDLY- |

(iii) FVIII Therapeutic Proteins and Uses Thereof for the Treatment of Hemophilia A The ceDNA vectors described herein can be used to deliver therapeutic FVIII proteins for treatment of hemophilia A associated with inappropriate expression of the FVIII protein and/or mutations within the FVIII proteins.

ceDNA vectors as described herein can be used to express any desired FVIII therapeutic protein. Exemplary therapeutic FVIII therapeutic proteins include but are not limited to any FVIII protein expressed by the sequences as set forth in Table 1 herein.

In one embodiment, the expressed FVIII therapeutic protein is functional for the treatment of a Hemophilia A. In some embodiments, FVIII therapeutic protein does not cause an immune system reaction.

In another embodiment, the ceDNA vectors encoding FVIII therapeutic protein or fragment thereof (e.g., functional fragment) can be used to generate a chimeric protein. Thus, it is specifically contemplated herein that a ceDNA vector expressing a chimeric protein can be administered to e.g., to any one or more tissues selected from: liver, kidneys, gallbladder, prostate, adrenal gland. In some embodiments, when a ceDNA vector expressing FVIII is administered to an infant, or administered to a subject in utero, one can administer a ceDNA vector expressing FVIII to any one or more tissues selected from: liver, adrenal gland, heart, intestine, lung, and stomach, or to a liver stem cell precursor thereof for the in vivo or ex vivo treatment of hemophilia A.

Hemophilia:

Hemophilia A is a genetic deficiency in clotting factor VIII, which causes increased bleeding and usually affects males. In the majority of cases it is inherited as an X-linked recessive trait, though there are cases which arise from spontaneous mutations. In terms of the symptoms of hemophilia A, there are internal or external bleeding episodes. Individuals with more severe hemophilia suffer more severe and more frequent bleeding, while others with mild hemophilia typically suffer more minor symptoms except after surgery or serious trauma. Moderate hemophiliacs have variable symptoms which manifest along a spectrum between severe and mild forms.

Current treatments to prevent bleeding in people with hemophilia A involves Factor VIII medication. Most individuals with severe hemophilia require regular supplementation with intravenous recombinant or plasma concentrate Factor VIII. Recombinant blood clotting factor VIII is one of the most complex proteins for industrial manufacturing due to the low efficiency of its gene transcription, massive intracellular loss of its proprotein during post-translational processing, and the instability of the secreted protein. Mild hemophiliacs can manage their condition with desmopressin, a drug which releases stored factor VIII from blood vessel walls.

There are many complications related to treatment of hemophilia A. In children, an easily accessible intravenous port can be inserted to minimize frequent traumatic intravenous cannulation. However, these ports are associated with high infection rate and a risk of clots forming at the tip of the catheter, rendering it useless. Viral infections can be common in hemophiliacs due to frequent blood transfusions which put patients at risk of acquiring blood borne infections, such as HIV, hepatitis B and hepatitis C. Prion infections can also be transmitted by blood transfusions. Another therapeutic complication of hemophilia A is the development of inhibitor antibodies against factor VIII due to frequent infusions. These develop as the body recognizes the infused factor VIII as foreign, as the body does not produce its own copy. In these individuals, activated factor VII, a precursor to factor VIII in the coagulation cascade, can be infused as a treatment for hemorrhage in individuals with hemophilia and antibodies against replacement factor VIII.

Coagulation Cascade

Coagulation, also known as clotting, is the process by which blood changes from a liquid to a gel, forming a blood clot. It potentially results in hemostasis, the cessation of blood loss from a damaged vessel, followed by repair. The mechanism of coagulation involves activation, adhesion and aggregation of platelets along with deposition and maturation of fibrin. Disorders of coagulation are disease states which can result in bleeding (hemorrhage or bruising) or obstructive clotting (thrombosis).

Coagulation begins almost instantly after an injury to the blood vessel has damaged the endothelium lining the blood vessel. Exposure of blood to the subendothelial space initiates two processes: changes in platelets, and the exposure of subendothelial tissue factor to plasma Factor VII, which ultimately leads to fibrin formation. Platelets immediately form a plug at the site of injury; this is called primary hemostasis. Secondary hemostasis occurs simultaneously: additional coagulation factors or clotting factors beyond Factor VII (including Factor VIII) respond in a complex cascade to form fibrin strands, which strengthen the platelet plug.

The coagulation cascade of secondary hemostasis has two initial pathways which lead to fibrin formation. These are the contact activation pathway (also known as the intrinsic pathway), and the tissue factor pathway (also known as the extrinsic pathway), which both lead to the same fundamental reactions that produce fibrin. The primary pathway for the initiation of blood coagulation is the tissue factor (extrinsic) pathway. The pathways are a series of reactions, in which a zymogen (inactive enzyme precursor) of a serine protease and its glycoprotein co-factor are activated to become active components that then catalyze the next reaction in the cascade, ultimately resulting in cross-linked fibrin. Coagulation factors are generally indicated by Roman numerals, with a lowercase a appended to indicate an active form.

The coagulation factors are generally serine proteases (enzymes), which act by cleaving downstream proteins. The exceptions are tissue factor, FV, FVIII, FXIII. Tissue factor, FV and FVIII are glycoproteins, and Factor XIII is a transglutaminase. The coagulation factors circulate as inactive zymogens. The coagulation cascade is therefore classically divided into three pathways. The tissue factor and contact activation pathways both activate the “final common pathway” of factor X, thrombin and fibrin.

The main role of the tissue factor (extrinsic) pathway is to generate a “thrombin burst”, a process by which thrombin, the most important constituent of the coagulation cascade in terms of its feedback activation roles, is released very rapidly. FVIIa circulates in a higher amount than any other activated coagulation factor. The process includes the following steps:

Step 1: Following damage to the blood vessel, FVII leaves the circulation and comes into contact with tissue factor (TF) expressed on tissue-factor-bearing cells (stromal fibroblasts and leukocytes), forming an activated complex (TF-FVIIa).

Step 2: TF-FVIIa activates FIX and FX.

Step 3: FVII is itself activated by thrombin, FXIa, FXII and FXa.

Step 4: The activation of FX (to form FXa) by TF-FVIIa is almost immediately inhibited by tissue factor pathway inhibitor (TFPI).

Step 5: FXa and its co-factor FVa form the prothrombinase complex, which activates prothrombin to thrombin.

Step 6: Thrombin then activates other components of the coagulation cascade, including FV and FVIII (which forms a complex with FIX), and activates and releases FVIII from being bound to von Willebrand factor (vWF).

Step 7: FVIIIa is the co-factor of FIXa, and together they form the "tenase" complex, which activates FX; and so the cycle continues.

The contact activation (intrinsic) pathway begins with formation of the primary complex on collagen by high-molecular-weight kininogen (HMWK), prekallikrein, and FXII (Hageman factor). Prekallikrein is converted to kallikrein and FXII becomes FXIIa. FXIIa converts FXI into FXIa. Factor XIa activates FIX, which with its co-factor FVIIIa form the tenase complex, which activates FX to FXa. The minor role that the contact activation pathway has in initiating clot formation can be illustrated by the fact that patients with severe deficiencies of FXII, HMWK, and prekallikrein do not have a bleeding disorder. Instead, contact activation system is more involved in inflammation, and innate immunity.

The final common pathway shared by the intrinsic and extrinsic coagulation pathways involves the conversion of prothrombin into thrombin and fibrinogen into fibrin. Thrombin has a large array of functions, not only the conversion of fibrinogen to fibrin, the building block of a hemostatic plug. In addition, it is the most important platelet activator and on top of that it activates Factors VIII and V and their inhibitor protein C (in the presence of thrombomodulin), and it activates Factor XIII, which forms covalent bonds that crosslink the fibrin polymers that form from activated monomers.

Following activation by the contact factor or tissue factor pathways, the coagulation cascade is maintained in a prothrombotic state by the continued activation of FVIII and FIX to form the tenase complex, until it is down-regulated by the anticoagulant pathways. The methods comprise administering to the subject an effective amount of a composition comprising a ceDNA vector encoding the FVIII therapeutic protein or fragment thereof (e.g., functional fragment) as described herein. As will be appreciated by a skilled practitioner, the term "effective amount" refers to the amount of the ceDNA composition administered that results in expression of the protein in a "therapeutically effective amount" for the treatment of a disease or disorder.

The dosage ranges for the composition comprising a ceDNA vector encoding the FVIII therapeutic protein or fragment thereof (e.g., functional fragment) depends upon the potency (e.g., efficiency of the promoter), and includes amounts large enough to produce the desired effect, e.g., expression of the desired FVIII therapeutic protein, for the treatment of Phenylketonuria (hemophilia A). The dosage should not be so large as to cause unacceptable adverse side effects. Generally, the dosage will vary with the particular characteristics of the ceDNA vector, expression efficiency and with the age, condition, and sex of the patient. The dosage can be determined by one of skill in the art and, unlike traditional AAV vectors, can also be adjusted by the individual physician in the event of any complication because ceDNA vectors do not comprise immune activating capsid proteins that prevent repeat dosing.

Administration of the ceDNA compositions described herein can be repeated for a limited period of time. In some embodiments, the doses are given periodically or by pulsed administration. In a preferred embodiment, the doses recited above are administered over several months. The duration of treatment depends upon the subject's clinical progress and responsiveness to therapy. Booster treatments over time are contemplated. Further, the level of expression can be titrated as the subject grows.

An FVIII therapeutic protein can be expressed in a subject for at least 1 week, at least 2 weeks, at least 1 month, at least 2 months, at least 6 months, at least 12 months/one year, at least 2 years, at least 5 years, at least 10 years, at least 15 years, at least 20 years, at least 30 years, at least 40 years, at least 50 years or more. Long-term expression can be achieved by repeated administration of the ceDNA vectors described herein at predetermined or desired intervals.

As used herein, the term "therapeutically effective amount" is an amount of an expressed FVIII therapeutic protein, or functional fragment thereof that is sufficient to produce a statistically significant, measurable change in expression of a disease biomarker or reduction in a given disease symptom (see "Efficacy Measurement" below). Such effective amounts can be gauged in clinical trials as well as animal studies for a given ceDNA composition.

Precise amounts of the ceDNA vector required to be administered depend on the judgment of the practitioner and are particular to each individual. Suitable regimes for administration are also variable, but are typified by an initial administration followed by repeated doses at one or more intervals by a subsequent injection or other administration. Alternatively, continuous intravenous infusion sufficient to maintain concentrations in the blood in the ranges specified for in vivo therapies are contemplated, particularly for the treatment of acute diseases/disorders.

Agents useful in the methods and compositions described herein can be administered topically, intravenously (by bolus or continuous infusion), intracellular injection, intratissue injection, orally, by inhalation, intraperitoneally, intramuscularly, subcutaneously, intracavity, and can be delivered by peristaltic means, if desired, or by other means known by those skilled in the art. The agent can be administered systemically, if so desired. It can also be administered in utero.

The efficacy of a given treatment for hemophilia A, can be determined by the skilled clinician. However, a treatment is considered "effective treatment," as the term is used herein, if any one or all of the signs or symptoms of the disease or disorder is/are altered in a beneficial manner, or other clinically accepted symptoms or markers of disease are improved, or ameliorated, e.g., by at least 10% following treatment with a ceDNA vector encoding FVIII, or a functional fragment thereof. Efficacy can also be measured by failure of an individual to worsen as assessed by stabilization of the disease, or the need for medical interventions (i.e., progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing progression of the disease or disorder; or (2) relieving the disease, e.g., causing regression of symptoms; and (3) preventing or reducing the likelihood of the development of the disease, or preventing secondary diseases/disorders associated with the disease, such as liver or kidney failure. An effective amount for the treatment of a disease means that amount which, when administered to a mammal in need thereof, is sufficient to result in effective treatment as that term is defined herein, for that disease.

Efficacy of an agent can be determined by assessing physical indicators that are particular to hemophilia A. Standard methods of analysis of hemophilia A indicators are known in the art.

In some embodiments, a ceDNA vector for expression of FVIII protein as disclosed herein can also encode co-factors or other polypeptides, sense or antisense oligonucleotides, or RNAs (coding or non-coding; e.g., siRNAs, shRNAs, micro-RNAs, and their antisense counterparts (e.g., antagoMiR)) that can be used in conjunction with the FVIII protein expressed from the ceDNA. Additionally, expression cassettes comprising sequence encoding an FVIII protein can also include an exogenous sequence that encodes a reporter protein to be used for experimental or diagnostic purposes, such as β-lactamase, β-galactosidase (LacZ), alkaline phosphatase, thymidine kinase, green fluorescent protein (GFP), chloramphenicol acetyltransferase (CAT), luciferase, and others well known in the art.

In one embodiment, the ceDNA vector comprises a nucleic acid sequence to express the FVIII protein that is functional for the treatment of hemophilia A. In a preferred embodiment, the therapeutic FVIII protein does not cause an immune system reaction, unless so desired.

III. ceDNA Vector in General for Use in Production of FVIII Therapeutic Proteins Embodiments of the invention are based on methods and compositions comprising close ended linear duplexed (ceDNA) vectors that can express the FVIII transgene. In some embodiments, the transgene is a sequence encoding an FVIII protein. The ceDNA vectors for expression of FVIII protein as described herein are not limited by size, thereby permitting, for example, expression of all of the components necessary for expression of a transgene from a single vector. The ceDNA vector for expression of FVIII protein is preferably duplex, e.g. self-complementary, over at least a portion of the molecule, such as the expression cassette (e.g. ceDNA is not a double stranded circular molecule). The ceDNA vector has covalently closed ends, and thus is resistant to exonuclease digestion (e.g. exonuclease I or exonuclease III), e.g. for over an hour at 37° C.

In general, a ceDNA vector for expression of FVIII protein as disclosed herein, comprises in the 5' to 3' direction: a first adeno-associated virus (AAV) inverted terminal repeat (ITR), a nucleotide sequence of interest (for example an expression cassette as described herein) and a second AAV ITR. The ITR sequences selected from any of: (i) at least one WT ITR and at least one modified AAV inverted terminal repeat (mod-ITR) (e.g., asymmetric modified ITRs); (ii) two modified ITRs where the mod-ITR pair have a different three-dimensional spatial organization with respect to each other (e.g., asymmetric modified ITRs), or (iii) symmetrical or substantially symmetrical WT-WT ITR pair, where each WT-ITR has the same three-dimensional spatial organization, or (iv) symmetrical or substantially symmetrical modified ITR pair, where each mod-ITR has the same three-dimensional spatial organization.

Encompassed herein are methods and compositions comprising the ceDNA vector for FVIII protein production, which may further include a delivery system, such as but not limited to, a liposome nanoparticle delivery system. Non-limiting exemplary liposome nanoparticle systems encompassed for use are disclosed herein. In some aspects, the disclosure provides for a lipid nanoparticle comprising ceDNA and an ionizable lipid. For example, a lipid nanoparticle formulation that is made and loaded with a ceDNA vector obtained by the process is disclosed in International Application PCT/US2018/050042, filed on Sep. 7, 2018, which is incorporated herein.

The ceDNA vectors for expression of FVIII protein as disclosed herein have no packaging constraints imposed by the limiting space within the viral capsid. ceDNA vectors represent a viable eukaryotically-produced alternative to prokaryote-produced plasmid DNA vectors, as opposed to encapsulated AAV genomes. This permits the insertion of control elements, e.g., regulatory switches as disclosed herein, large transgenes, multiple transgenes etc.

FIG. 1A-1E show schematics of non-limiting, exemplary ceDNA vectors for expression of FVIII protein, or the corresponding sequence of ceDNA plasmids. ceDNA vectors for expression of FVIII protein are capsid-free and can be obtained from a plasmid encoding in this order: a first ITR, an expression cassette comprising a transgene and a second ITR. The expression cassette may include one or more regulatory sequences that allows and/or controls the expression of the transgene, e.g., where the expression cassette can comprise one or more of, in this order: an enhancer/promoter, an ORF reporter (transgene), a post-transcription regulatory element (e.g., WPRE), and a polyadenylation and termination signal (e.g., BGH polyA).

The expression cassette can also comprise an internal ribosome entry site (IRES) and/or a 2A element. The cis-regulatory elements include, but are not limited to, a promoter, a riboswitch, an insulator, a mir-regulatable element, a post-transcriptional regulatory element, a tissue- and cell type-specific promoter and an enhancer. In some embodiments the ITR can act as the promoter for the transgene, e.g., FVIII protein. In some embodiments, the ceDNA vector comprises additional components to regulate expression of the transgene, for example, a regulatory switch, which are described herein in the section entitled "Regulatory Switches" for controlling and regulating the expression of the FVIII protein, and can include if desired, a regulatory switch which is a kill switch to enable controlled cell death of a cell comprising a ceDNA vector.

The expression cassette can comprise more than 4000 nucleotides, 5000 nucleotides, 10,000 nucleotides or 20,000 nucleotides, or 30,000 nucleotides, or 40,000 nucleotides or 50,000 nucleotides, or any range between about 4000-10,000 nucleotides or 10,000-50,000 nucleotides, or more than 50,000 nucleotides. In some embodiments, the expression cassette can comprise a transgene in the range of 500 to 50,000 nucleotides in length. In some embodiments, the expression cassette can comprise a transgene in the range of 500 to 75,000 nucleotides in length. In some embodiments, the expression cassette can comprise a transgene which is in the range of 500 to 10,000 nucleotides in length. In some embodiments, the expression cassette can comprise a transgene which is in the range of 1000 to 10,000 nucleotides in length. In some embodiments, the expression cassette can comprise a transgene which is in the range of 500 to 5,000 nucleotides in length. The ceDNA vectors do not have the size limitations of encapsidated AAV vectors, thus enable delivery of a large-size expression cassette to provide efficient transgene expression. In some embodiments, the ceDNA vector is devoid of prokaryote-specific methylation.

ceDNA expression cassette can include, for example, an expressible exogenous sequence (e.g., open reading frame) or transgene that encodes a protein that is either absent, inactive, or insufficient activity in the recipient subject or a gene that encodes a protein having a desired biological or a therapeutic effect. The transgene can encode a gene product that can function to correct the expression of a defective gene or transcript. In principle, the expression cassette can include any gene that encodes a protein, polypeptide or RNA that is either reduced or absent due to a mutation or which conveys a therapeutic benefit when overexpressed is considered to be within the scope of the disclosure.

The expression cassette can comprise any transgene (e.g., encoding FVIII protein), for example, FVIII protein useful for treating hemophilia A in a subject, i.e., a therapeutic FVIII protein. A ceDNA vector can be used to deliver and express any FVIII protein of interest in the subject, alone or in combination with nucleic acids encoding polypeptides, or non-coding nucleic acids (e.g., RNAi, miRs etc.), as well as exogenous genes and nucleotide sequences, including virus sequences in a subjects' genome, e.g., HIV virus sequences and the like. Preferably a ceDNA vector disclosed herein is used for therapeutic purposes (e.g., for medical, diagnostic, or veterinary uses) or immunogenic polypeptides. In certain embodiments, a ceDNA vector is useful to express any gene of interest in the subject, which includes one or more polypeptides, peptides, ribozymes, peptide nucleic acids, siRNAs, RNAis, antisense oligonucleotides, antisense polynucleotides, or RNAs (coding or non-coding; e.g., siRNAs, shRNAs, micro-RNAs, and their antisense counterparts (e.g., antagoMiR)), antibodies, fusion proteins, or any combination thereof.

The expression cassette can also encode polypeptides, sense or antisense oligonucleotides, or RNAs (coding or non-coding; e.g., siRNAs, shRNAs, micro-RNAs, and their antisense counterparts (e.g., antagoMiR)). Expression cassettes can include an exogenous sequence that encodes a reporter protein to be used for experimental or diagnostic purposes, such as β-lactamase, β-galactosidase (LacZ), alkaline phosphatase, thymidine kinase, green fluorescent protein (GFP), chloramphenicol acetyltransferase (CAT), luciferase, and others well known in the art.

Sequences provided in the expression cassette, expression construct of a ceDNA vector for expression of FVIII protein described herein can be codon optimized for the target host cell. As used herein, the term "codon optimized" or "codon optimization" refers to the process of modifying a nucleic acid sequence for enhanced expression in the cells of the vertebrate of interest, e.g., mouse or human, by replacing at least one, more than one, or a significant number of codons of the native sequence (e.g., a prokaryotic sequence) with codons that are more frequently or most frequently used in the genes of that vertebrate. Various species exhibit particular bias for certain codons of a particular amino acid. Typically, codon optimization does not alter the amino acid sequence of the original translated protein. Optimized codons can be determined using e.g., Aptagen's Gene Forge® codon optimization and custom gene synthesis platform (Aptagen, Inc., 2190 Fox Mill Rd. Suite 300, Herndon, Va. 20171) or another publicly available database. In some embodiments, the nucleic acid encoding the FVIII protein is optimized for human expression, and/or is a human FVIII, or functional fragment thereof, as known in the art.

Figure 4A:
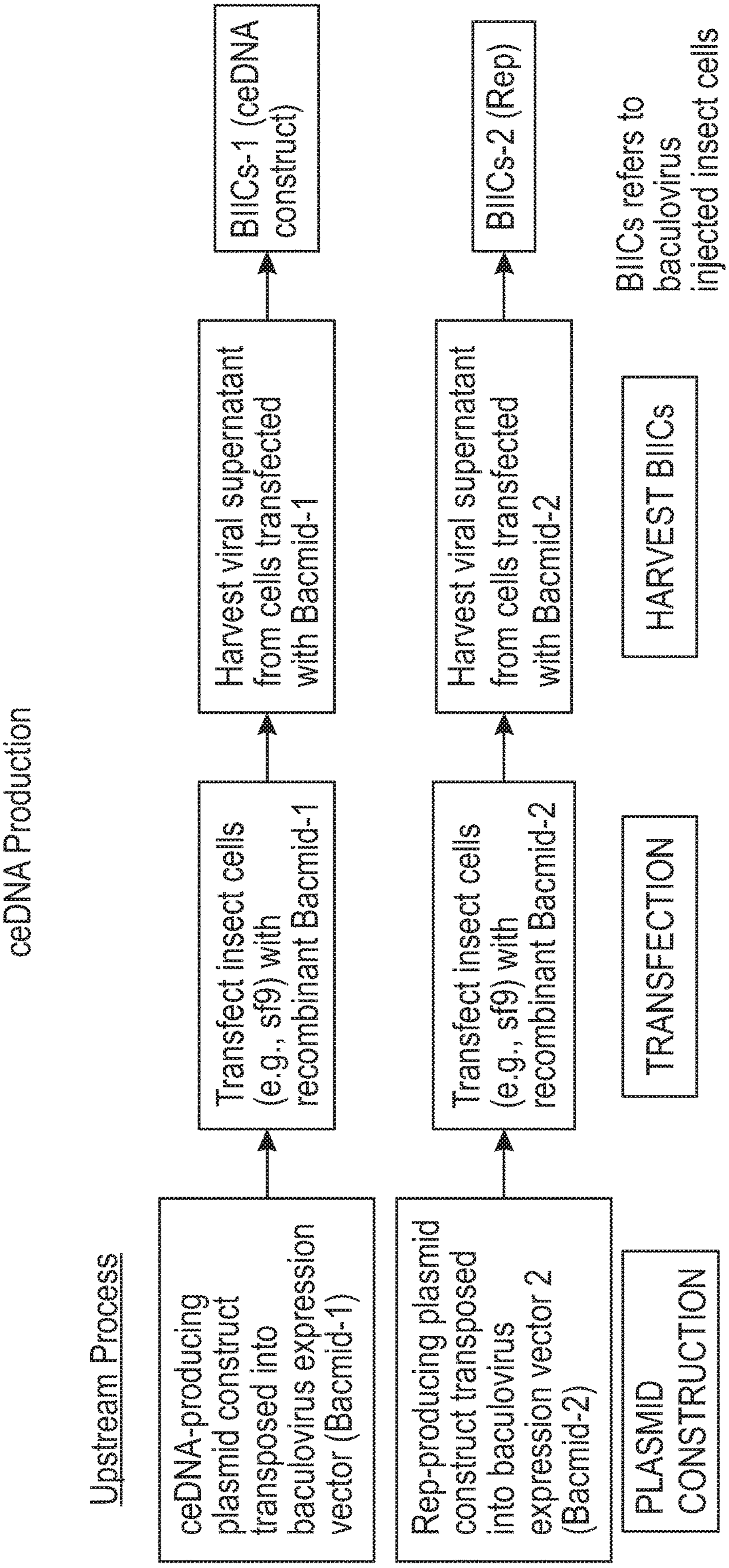
FIG. 4A is a schematic illustrating an upstream process for making baculovirus infected insect cells (BIICs) that are useful in the production of a ceDNA vector for expression of the FVIII as disclosed herein in the process described in the schematic in FIG. 4B.
Figure 4B:
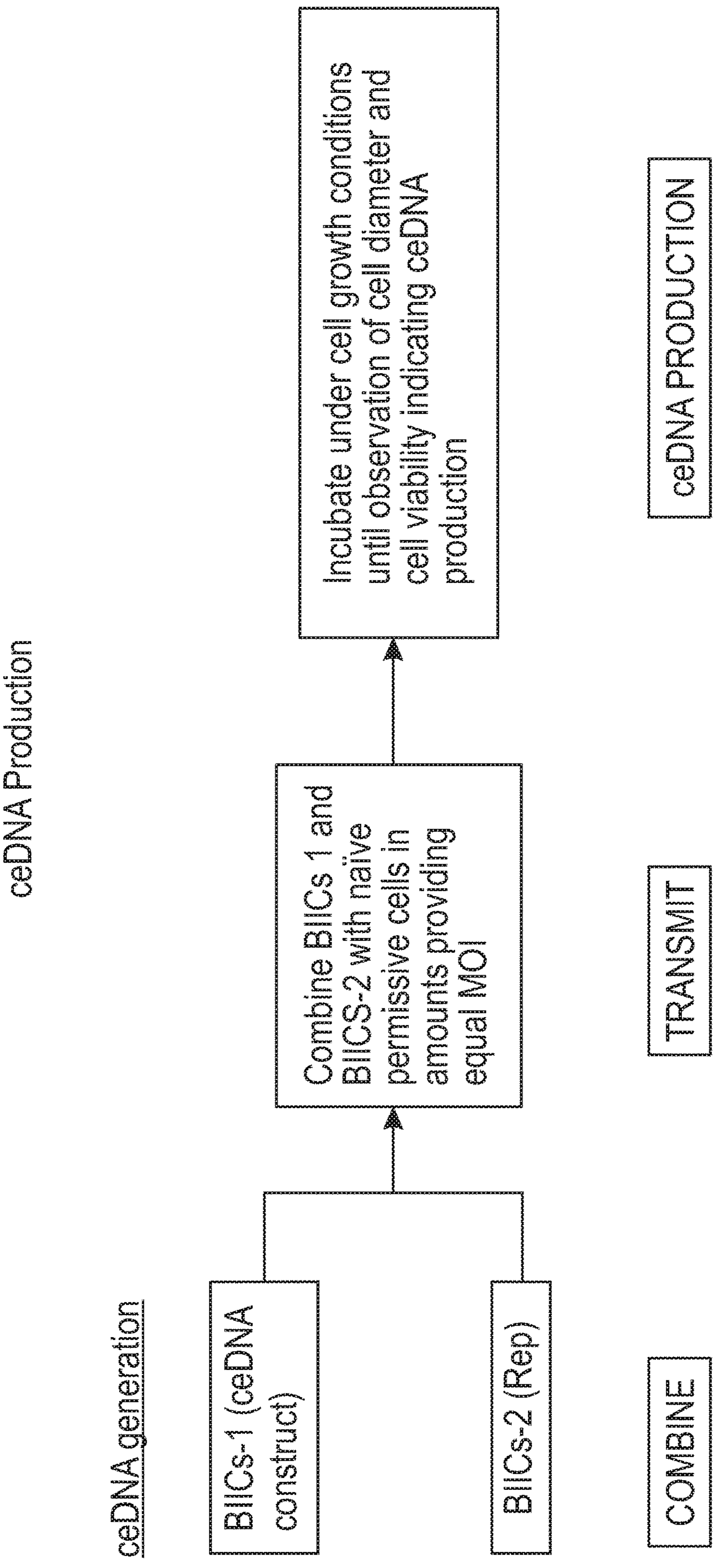
FIG. 4B is a schematic of an exemplary method of ceDNA production and FIG. 4C illustrates a biochemical method and process to confirm ceDNA vector production.
Figure 4C:
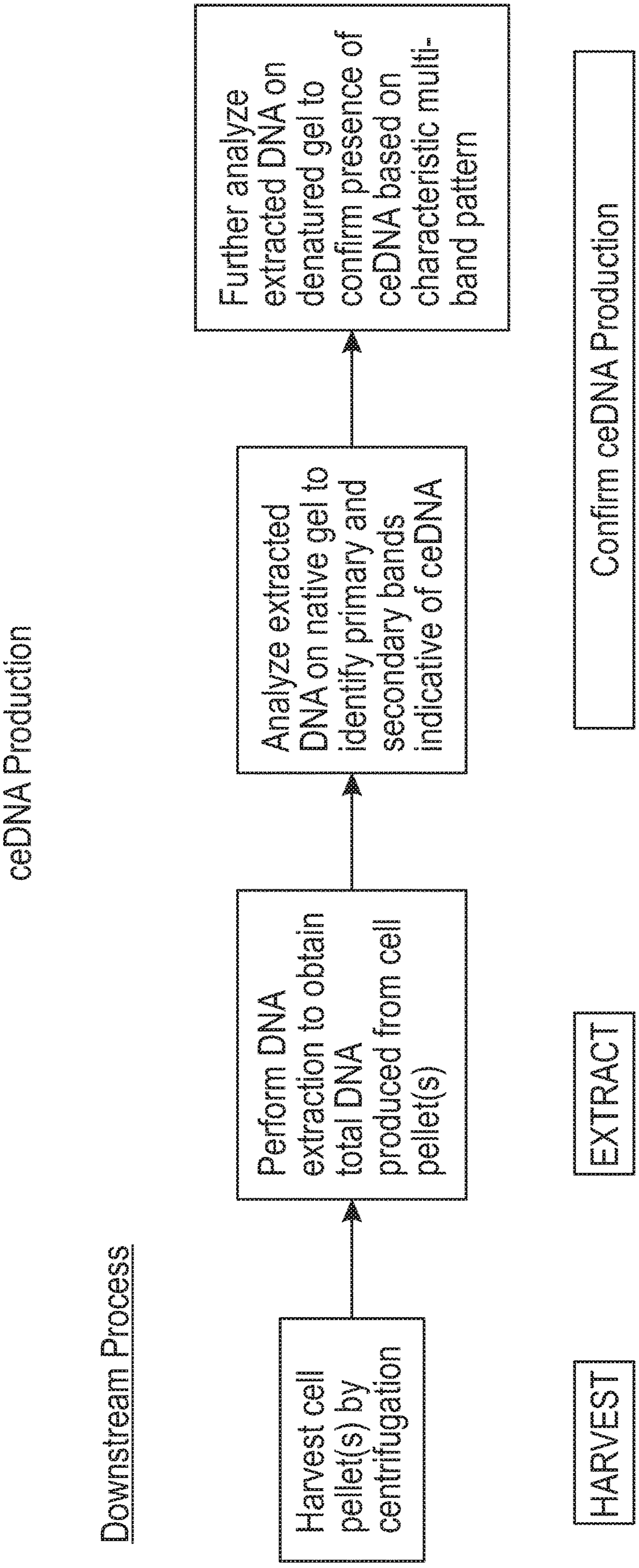
Figure 4D:
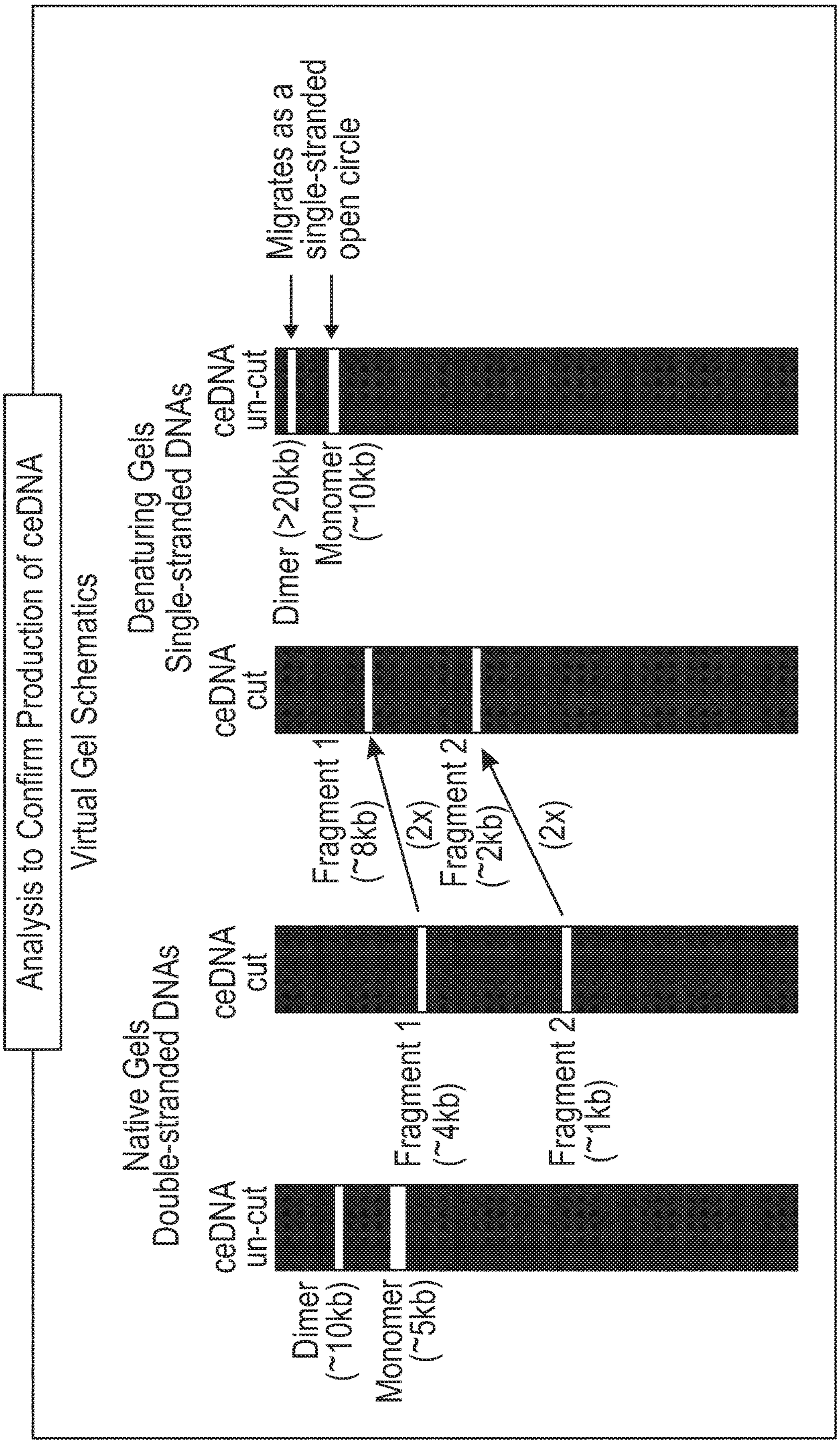
FIG. 4D and FIG. 4E are schematic illustrations describing a process for identifying the presence of ceDNA in DNA harvested from cell pellets obtained during the ceDNA production processes in FIG. 4B.

A transgene expressed by the ceDNA vector for expression of FVIII protein as disclosed herein encodes FVIII protein. There are many structural features of ceDNA vectors for expression of FVIII protein that differ from plasmid-based expression vectors. ceDNA vectors may possess one or more of the following features: the lack of original (i.e. not inserted) bacterial DNA, the lack of a prokaryotic origin of replication, being self-containing, i.e., they do not require any sequences other than the two ITRs, including the Rep binding and terminal resolution sites (RBS and TRS), and an exogenous sequence between the ITRs, the presence of ITR sequences that form hairpins, and the absence of bacterial-type DNA methylation or indeed any other methylation considered abnormal by a mammalian host. In general, it is preferred for the present vectors not to contain any prokaryotic DNA but it is contemplated that some prokaryotic DNA may be inserted as an exogenous sequence, as a non-limiting example in a promoter or enhancer region. Another important feature distinguishing ceDNA vectors from plasmid expression vectors is that ceDNA vectors are single-strand linear DNA having closed ends, while plasmids are always double-strand DNA.

ceDNA vectors for expression of FVIII protein produced by the methods provided herein preferably have a linear and continuous structure rather than a non-continuous structure, as determined by restriction enzyme digestion assay (FIG. 4D). The linear and continuous structure is believed to be more stable from attack by cellular endonucleases, as well as less likely to be recombined and cause mutagenesis. Thus, a ceDNA vector in the linear and continuous structure is a preferred embodiment. The continuous, linear, single strand intramolecular duplex ceDNA vector can have covalently bound terminal ends, without sequences encoding AAV capsid proteins. These ceDNA vectors are structurally distinct from plasmids (including ceDNA plasmids described herein), which are circular duplex nucleic acid molecules of bacterial origin. The complimentary strands of plasmids may be separated following denaturation to produce two nucleic acid molecules, whereas in contrast, ceDNA vectors, while having complimentary strands, are a single DNA molecule and therefore even if denatured, remain a single molecule. In some embodiments, ceDNA vectors as described herein can be produced without DNA base methylation of prokaryotic type, unlike plasmids. Therefore, the ceDNA vectors and ceDNA-plasmids are different both in term of structure (in particular, linear versus circular) and also in view of the methods used for producing and purifying these different objects (see below), and also in view of their DNA methylation which is of prokaryotic type for ceDNA-plasmids and of eukaryotic type for the ceDNA vector.

There are several advantages of using a ceDNA vector for expression of FVIII protein as described herein over plasmid-based expression vectors, such advantages include, but are not limited to: 1) plasmids contain bacterial DNA sequences and are subjected to prokaryotic-specific methylation, e.g., 6-methyl adenosine and 5-methyl cytosine methylation, whereas capsid-free AAV vector sequences are of eukaryotic origin and do not undergo prokaryotic-specific methylation; as a result, capsid-free AAV vectors are less likely to induce inflammatory and immune responses compared to plasmids; 2) while plasmids require the presence of a resistance gene during the production process, ceDNA vectors do not; 3) while a circular plasmid is not delivered to the nucleus upon introduction into a cell and requires overloading to bypass degradation by cellular nucleases, ceDNA vectors contain viral cis-elements, i.e., ITRs, that confer resistance to nucleases and can be designed to be targeted and delivered to the nucleus. It is hypothesized that the minimal defining elements indispensable for ITR function are a Rep-binding site (RBS; 5'-GCGCGCTCGCTCGCTC-3' (SEQ ID NO: 60) for AAV2) and a terminal resolution site (TRS; 5'-AGTTGG-3' (SEQ ID NO: 64) for AAV2) plus a variable palindromic sequence allowing for hairpin formation; and 4) ceDNA vectors do not have the over-representation of CpG dinucleotides often found in prokaryote-derived plasmids that reportedly binds a member of the Toll-like family of receptors, eliciting a T cell-mediated immune response. In contrast, transductions with capsid-free AAV vectors disclosed herein can efficiently target cell and tissue-types that are difficult to transduce with conventional AAV virions using various delivery reagent.

IV. Inverted Terminal Repeats (ITRs)

As disclosed herein, ceDNA vectors for expression of FVIII protein contain a transgene or heterologous nucleic acid sequence positioned between two inverted terminal repeat (ITR) sequences, where the ITR sequences can be an asymmetrical ITR pair or a symmetrical- or substantially symmetrical ITR pair, as these terms are defined herein. A ceDNA vector as disclosed herein can comprise ITR sequences that are selected from any of: (i) at least one WT ITR and at least one modified AAV inverted terminal repeat (mod-ITR) (e.g., asymmetric modified ITRs); (ii) two modified ITRs where the mod-ITR pair have a different three-dimensional spatial organization with respect to each other (e.g., asymmetric modified ITRs), or (iii) symmetrical or substantially symmetrical WT-WT ITR pair, where each WT-ITR has the same three-dimensional spatial organization, or (iv) symmetrical or substantially symmetrical modified ITR pair, where each mod-ITR has the same three-dimensional spatial organization, where the methods of the present disclosure may further include a delivery system, such as but not limited to a liposome nanoparticle delivery system.

In some embodiments, the ITR sequence can be from viruses of the Parvoviridae family, which includes two subfamilies: Parvovirinae, which infect vertebrates, and Densovirinae, which infect insects. The subfamily Parvovirinae (referred to as the parvoviruses) includes the genus Dependovirus, the members of which, under most conditions, require coinfection with a helper virus such as adenovirus or herpes virus for productive infection. The genus Dependovirus includes adeno-associated virus (AAV), which normally infects humans (e.g., serotypes 2, 3A, 3B, 5, and 6) or primates (e.g., serotypes 1 and 4), and related viruses that infect other warm-blooded animals (e.g., bovine, canine, equine, and ovine adeno-associated viruses). The parvoviruses and other members of the Parvoviridae family are generally described in Kenneth I. Berns, “Parvoviridae: The Viruses and Their Replication,” Chapter 69 in FIELDS VIROLOGY (3d Ed. 1996).

While ITRs exemplified in the specification and Examples herein are AAV2 WT-ITRs, one of ordinary skill in the art is aware that one can as stated above use ITRs from any known parvovirus, for example a dependovirus such as AAV (e.g., AAV1, AAV2, AAV3, AAV4, AAV5, AAV 5, AAV7, AAV8, AAV9, AAV10, AAV 11, AAV12, AAVrh8, AAVrh10, AAV-DJ, and AAV-DJ8 genome. E.g., NCBI: NC 002077; NC 001401; NC001729; NC001829; NC006152; NC 006260; NC 006261), chimeric ITRs, or ITRs from any synthetic AAV. In some embodiments, the AAV can infect warm-blooded animals, e.g., avian (AAAV), bovine (BAAV), canine, equine, and ovine adeno-associated viruses. In some embodiments the ITR is from B19 parvovirus (GenBank Accession No: NC 000883), Minute Virus from Mouse (MVM) (GenBank Accession No. NC 001510); goose parvovirus (GenBank Accession No. NC 001701); snake parvovirus 1 (GenBank Accession No. NC 006148). In some embodiments, the 5' WT-ITR can be from one serotype and the 3' WT-ITR from a different serotype, as discussed herein.

An ordinarily skilled artisan is aware that ITR sequences have a common structure of a double-stranded Holliday junction, which typically is a T-shaped or Y-shaped hairpin structure (see e.g., FIG. 2A and FIG. 3A), where each WT-ITR is formed by two palindromic arms or loops (B-B' and C-C') embedded in a larger palindromic arm (A-A'), and a single stranded D sequence, (where the order of these palindromic sequences defines the flip or flop orientation of the ITR). See, for example, structural analysis and sequence comparison of ITRs from different AAV serotypes (AAV1-AAV6) and described in Grimm et al., J. Virology, 2006; 80(1); 426-439; Yan et al., J. Virology, 2005; 364-379; Duan et al., Virology 1999; 261; 8-14. One of ordinary skill in the art can readily determine WT-ITR sequences from any AAV serotype for use in a ceDNA vector or ceDNA-plasmid based on the exemplary AAV2 ITR sequences provided herein. See, for example, the sequence comparison of ITRs from different AAV serotypes (AAV1-AAV6, and avian AAV (AAAV) and bovine AAV (BAAV)) described in Grimm et al., J. Virology, 2006; 80(1); 426-439; that show the % identity of the left ITR of AAV2 to the left ITR from other serotypes: AAV-1 (84%), AAV-3 (86%), AAV-4 (79%), AAV-5 (58%), AAV-6 (left ITR) (100%) and AAV-6 (right ITR) (82%).

A. Symmetrical ITR Pairs

In some embodiments, a ceDNA vector for expression of FVIII protein as described herein comprises, in the 5' to 3' direction: a first adeno-associated virus (AAV) inverted terminal repeat (ITR), a nucleotide sequence of interest (for example an expression cassette as described herein) and a second AAV ITR, where the first ITR (5' ITR) and the second ITR (3' ITR) are symmetric, or substantially symmetrical with respect to each other—that is, a ceDNA vector can comprise ITR sequences that have a symmetrical three-dimensional spatial organization such that their structure is the same shape in geometrical space, or have the same A, C-C' and B-B' loops in 3D space. In such an embodiment, a symmetrical ITR pair, or substantially symmetrical ITR pair can be modified ITRs (e.g., mod-ITRs) that are not wild-type ITRs. A mod-ITR pair can have the same sequence which has one or more modifications from wild-type ITR and are reverse complements (inverted) of each other. In alternative embodiments, a modified ITR pair are substantially symmetrical as defined herein, that is, the modified ITR pair can have a different sequence but have corresponding or the same symmetrical three-dimensional shape.

(i) Wildtype ITRs

In some embodiments, the symmetrical ITRs, or substantially symmetrical ITRs are wild type (WT-ITRs) as described herein. That is, both ITRs have a wild type sequence, but do not necessarily have to be WT-ITRs from the same AAV serotype. That is, in some embodiments, one WT-ITR can be from one AAV serotype, and the other WT-ITR can be from a different AAV serotype. In such an embodiment, a WT-ITR pair are substantially symmetrical as defined herein, that is, they can have one or more conservative nucleotide modification while still retaining the symmetrical three-dimensional spatial organization.

Accordingly, as disclosed herein, ceDNA vectors contain a transgene or heterologous nucleic acid sequence positioned between two flanking wild-type inverted terminal repeat (WT-ITR) sequences, that are either the reverse complement (inverted) of each other, or alternatively, are substantially symmetrical relative to each other—that is a WT-ITR pair have symmetrical three-dimensional spatial organization. In some embodiments, a wild-type ITR sequence (e.g. AAV WT-ITR) comprises a functional Rep binding site (RBS; e.g. 5'-GCGCGCTCGCTCGCTC-3' for AAV2, SEQ ID NO: 60) and a functional terminal resolution site (TRS; e.g. 5'-AGTT-3', SEQ ID NO: 62).

In one aspect, ceDNA vectors for expression of FVIII protein are obtainable from a vector polynucleotide that encodes a heterologous nucleic acid operatively positioned between two WT inverted terminal repeat sequences (WT-ITRs) (e.g. AAV WT-ITRs). That is, both ITRs have a wild type sequence, but do not necessarily have to be WT-ITRs from the same AAV serotype. That is, in some embodiments, one WT-ITR can be from one AAV serotype, and the other WT-ITR can be from a different AAV serotype. In such an embodiment, the WT-ITR pair are substantially symmetrical as defined herein, that is, they can have one or more conservative nucleotide modification while still retaining the symmetrical three-dimensional spatial organization. In some embodiments, the 5' WT-ITR is from one AAV serotype, and the 3' WT-ITR is from the same or a different AAV serotype. In some embodiments, the 5' WT-ITR and the 3'WT-ITR are mirror images of each other, that is they are symmetrical. In some embodiments, the 5' WT-ITR and the 3' WT-ITR are from the same AAV serotype.

WT ITRs are well known. In one embodiment the two ITRs are from the same AAV2 serotype. In certain embodiments one can use WT from other serotypes. There are a number of serotypes that are homologous, e.g. AAV2, AAV4, AAV6, AAV8. In one embodiment, closely homologous ITRs (e.g. ITRs with a similar loop structure) can be used. In another embodiment, one can use AAV WT ITRs that are more diverse, e.g., AAV2 and AAV5, and still another embodiment, one can use an ITR that is substantially WT—that is, it has the basic loop structure of the WT but some conservative nucleotide changes that do not alter or affect the properties. When using WT-ITRs from the same viral serotype, one or more regulatory sequences may further be used. In certain embodiments, the regulatory sequence is a regulatory switch that permits modulation of the activity of the ceDNA, e.g., the expression of the encoded FVIII protein.

In some embodiments, one aspect of the technology described herein relates to a ceDNA vector for expression of FVIII protein, wherein the ceDNA vector comprises at least one heterologous nucleotide sequence encoding the FVIII protein, operably positioned between two wild-type inverted terminal repeat sequences (WT-ITRs), wherein the WT-ITRs can be from the same serotype, different serotypes or substantially symmetrical with respect to each other (i.e., have the symmetrical three-dimensional spatial organization such that their structure is the same shape in geometrical space, or have the same A, C-C' and B-B' loops in 3D space). In some embodiments, the symmetric WT-ITRs comprises a functional terminal resolution site and a Rep binding site. In some embodiments, the heterologous nucleic acid sequence encodes a transgene, and wherein the vector is not in a viral capsid.

In some embodiments, the WT-ITRs are the same but the reverse complement of each other. For example, the sequence AACG in the 5' ITR may be CGTT (i.e., the reverse complement) in the 3' ITR at the corresponding site. In one example, the 5' WT-ITR sense strand comprises the sequence of ATCGATCG and the corresponding 3' WT-ITR sense strand comprises CGATCGAT (i.e., the reverse complement of ATCGATCG). In some embodiments, the WT-ITRs ceDNA further comprises a terminal resolution site and a replication protein binding site (RPS) (sometimes referred to as a replicative protein binding site), e.g. a Rep binding site.

Exemplary WT-ITR sequences for use in the ceDNA vectors for expression of FVIII protein comprising WT-ITRs are shown in Table 3 herein, which shows pairs of WT-ITRs (5' WT-ITR and the 3' WT-ITR).

As an exemplary example, the present disclosure provides a ceDNA vector for expression of FVIII protein comprising a promoter operably linked to a transgene (e.g., heterologous nucleic acid sequence), with or without the regulatory switch, where the ceDNA is devoid of capsid proteins and is: (a) produced from a ceDNA-plasmid (e.g., see FIGS. 1F-1G) that encodes WT-ITRs, where each WT-ITR has the same number of intramolecularly duplexed base pairs in its hairpin secondary configuration (preferably excluding deletion of any AAA or TTT terminal loop in this configuration compared to these reference sequences), and (b) is identified as ceDNA using the assay for the identification of ceDNA by agarose gel electrophoresis under native gel and denaturing conditions in Example 1.

In some embodiments, the flanking WT-ITRs are substantially symmetrical to each other. In this embodiment the 5' WT-ITR can be from one serotype of AAV, and the 3' WT-ITR from a different serotype of AAV, such that the WT-ITRs are not identical reverse complements. For example, the 5' WT-ITR can be from AAV2, and the 3' WT-ITR from a different serotype (e.g. AAV1, 3, 4, 5, 6, 7, 8, 9, 10, 11, and 12. In some embodiments, WT-ITRs can be selected from two different parvoviruses selected from any to of: AAV1, AAV2, AAV3, AAV4, AAV5, AAV6, AAV7, AAV8, AAV9, AAV10, AAV11, AAV12, AAV13, snake parvovirus (e.g., royal python parvovirus), bovine parvovirus, goat parvovirus, avian parvovirus, canine parvovirus, equine parvovirus, shrimp parvovirus, porcine parvovirus, or insect AAV. In some embodiments, such a combination of WT ITRs is the combination of WT-ITRs from AAV2 and AAV6. In one embodiment, the substantially symmetrical WT-ITRs are when one is inverted relative to the other ITR at least 90% identical, at least 95% identical, at least 96% . . . 97% . . . 98% . . . 99% . . . 99.5% and all points in between, and has the same symmetrical three-dimensional spatial organization. In some embodiments, a WT-ITR pair are substantially symmetrical as they have symmetrical three-dimensional spatial organization, e.g., have the same 3D organization of the A, C-C', B-B' and D arms. In one embodiment, a substantially symmetrical WT-ITR pair are inverted relative to the other, and are at least 95% identical, at least 96% . . . 97% . . . 98% . . . 99% . . . 99.5% and all points in between, to each other, and one WT-ITR retains the Rep-binding site (RBS) of 5'-GCGCGCTCGCTCGCTC-3' (SEQ ID NO: 60) and a terminal resolution site (TRS). In some embodiments, a substantially symmetrical WT-ITR pair are inverted relative to each other, and are at least 95% identical, at least 96% . . . 97% . . . 98% . . . 99% . . . 99.5% and all points in between, to each other, and one WT-ITR retains the Rep-binding site (RBS) of 5'-GCGCGCTCGCTCGCTC-3' (SEQ ID NO: 60) and a terminal resolution site (TRS) and in addition to a variable palindromic sequence allowing for hairpin secondary structure formation. Homology can be determined by standard means well known in the art such as BLAST (Basic Local Alignment Search Tool), BLASTN at default setting.

In some embodiments, the structural element of the ITR can be any structural element that is involved in the functional interaction of the ITR with a large Rep protein (e.g., Rep 78 or Rep 68). In certain embodiments, the structural element provides selectivity to the interaction of an ITR with a large Rep protein, i.e., determines at least in part which Rep protein functionally interacts with the ITR. In other embodiments, the structural element physically interacts with a large Rep protein when the Rep protein is bound to the ITR. Each structural element can be, e.g., a secondary structure of the ITR, a nucleotide sequence of the ITR, a spacing between two or more elements, or a combination of any of the above. In one embodiment, the structural elements are selected from the group consisting of an A and an A' arm, a B and a B' arm, a C and a C' arm, a D arm, a Rep binding site (RBE) and an RBE' (i.e., complementary RBE sequence), and a terminal resolution sire (TRS).

By way of example only, Table 2 indicates exemplary combinations of WT-ITRs.

Table 2: Exemplary combinations of WT-ITRs from the same serotype or different serotypes, or different parvoviruses. The order shown is not indicative of the ITR position, for example, “AAV1, AAV2” demonstrates that the ceDNA can comprise a WT-AAV1 ITR in the 5' position, and a WT-AAV2 ITR in the 3' position, or vice versa, a WT-AAV2 ITR the 5' position, and a WT-AAV1 ITR in the 3' position. Abbreviations: AAV serotype 1 (AAV1), AAV serotype 2 (AAV2), AAV serotype 3 (AAV3), AAV serotype 4 (AAV4), AAV serotype 5 (AAV5), AAV serotype 6 (AAV6), AAV serotype 7 (AAV7), AAV serotype 8 (AAV8), AAV serotype 9 (AAV9), AAV serotype 10 (AAV10), AAV serotype 11 (AAV11), or AAV serotype 12 (AAV12); AAVrh8, AAVrh10, AAV-DJ, and AAV-DJ8 genome (E.g., NCBI: NC 002077; NC 001401; NC001729; NC001829; NC006152; NC 006260; NC 006261), ITRs from warm-blooded animals (avian AAV (AAAV), bovine AAV (BAAV), canine, equine, and ovine AAV), ITRs from B19 parvoviris (GenBank Accession No: NC 000883), Minute Virus from Mouse (MVM) (GenBank Accession No. NC 001510); Goose: goose parvovirus (GenBank Accession No. NC 001701); snake: snake parvovirus 1 (GenBank Accession No. NC 006148).

TABLE 2

| | | | | |
|---|---|---|---|---|
| AAV1, AAV1 | AAV2, AAV2 | AAV3, AAV3 | AAV4, AAV4 | AAV5, AAV5 |
| AAV1, AAV2 | AAV2, AAV3 | AAV3, AAV4 | AAV4, AAV5 | AAV5, AAV6 |
| AAV1, AAV3 | AAV2, AAV4 | AAV3, AAV5 | AAV4, AAV6 | AAV5, AAV7 |
| AAV1, AAV4 | AAV2, AAV5 | AAV3, AAV6 | AAV4, AAV7 | AAV5, AAV8 |
| AAV1, AAV5 | AAV2, AAV6 | AAV3, AAV7 | AAV4, AAV8 | AAV5, AAV9 |
| AAV1, AAV6 | AAV2, AAV7 | AAV3, AAV8 | AAV4, AAV9 | AAV5, AAV10 |
| AAV1, AAV7 | AAV2, AAV8 | AAV3, AAV9 | AAV4, AAV10 | AAV5, AAV11 |
| AAV1, AAV8 | AAV2, AAV9 | AAV3, AAV10 | AAV4, AAV11 | AAV5, AAV12 |
| AAV1, AAV9 | AAV2, AAV10 | AAV3, AAV11 | AAV4, AAV12 | AAV5, AAVRH8 |
| AAV1, AAV10 | AAV2, AAV11 | AAV3, AAV12 | AAV4, AAVRH8 | AAV5, AAVRH10 |
| AAV1, AAV11 | AAV2, AAV12 | AAV3, AAVRH8 | AAV4, AAVRH10 | AAV5, AAV13 |
| AAV1, AAV12 | AAV2, AAVRH8 | AAV3, AAVRH10 | AAV4, AAV13 | AAV5, AAVDJ |
| AAV1, AAVRH8 | AAV2, AAVRH10 | AAV3, AAV13 | AAV4, AAVDJ | AAV5, AAVDJ8 |
| AAV1, AAVRH10 | AAV2, AAV13 | AAV3, AAVDJ | AAV4, AAVDJ8 | AAV5, AVIAN |
| AAV1, AAV13 | AAV2, AAVDJ | AAV3, AAVDJ8 | AAV4, AVIAN | AAV5, BOVINE |
| AAV1, AAVDJ | AAV2, AAVDJ8 | AAV3, AVIAN | AAV4, BOVINE | AAV5, CANINE |
| AAV1, AAVDJ8 | AAV2, AVIAN | AAV3, BOVINE | AAV4, CANINE | AAV5, EQUINE |
| AAV1, AVIAN | AAV2, BOVINE | AAV3, CANINE | AAV4, EQUINE | AAV5, GOAT |
| AAV1, BOVINE | AAV2, CANINE | AAV3, EQUINE | AAV4, GOAT | AAV5, SHRIMP |
| AAV1, CANINE | AAV2, EQUINE | AAV3, GOAT | AAV4, SHRIMP | AAV5, PORCINE |
| AAV1, EQUINE | AAV2, GOAT | AAV3, SHRIMP | AAV4, PORCINE | AAV5, INSECT |
| AAV1, GOAT | AAV2, SHRIMP | AAV3, PORCINE | AAV4, INSECT | AAV5, OVINE |
| AAV1, SHRIMP | AAV2, PORCINE | AAV3, INSECT | AAV4, OVINE | AAV5, B19 |
| AAV1, PORCINE | AAV2, INSECT | AAV3, OVINE | AAV4, B19 | AAV5, MVM |
| AAV1, INSECT | AAV2, OVINE | AAV3, B19 | AAV4, MVM | AAV5, GOOSE |
| AAV1, OVINE | AAV2, B19 | AAV3, MVM | AAV4, GOOSE | AAV5, SNAKE |
| AAV1, B19 | AAV2, MVM | AAV3, GOOSE | AAV4, SNAKE | |
| AAV1, MVM | AAV2, GOOSE | AAV3, SNAKE | | |
| AAV1, GOOSE | AAV2, SNAKE | | | |
| AAV1, SNAKE | | | | |
| AAV6, AAV6 | AAV7, AAV7 | AAV8, AAV8 | AAV9, AAV9 | AAV10, AAV10 |
| AAV6, AAV7 | AAV7, AAV8 | AAV8, AAV9 | AAV9, AAV10 | AAV10, AAV11 |
| AAV6, AAV8 | AAV7, AAV9 | AAV8, AAV10 | AAV9, AAV11 | AAV10, AAV12 |
| AAV6, AAV9 | AAV7, AAV10 | AAV8, AAV11 | AAV9, AAV12 | AAV10, AAVRH8 |
| AAV6, AAV10 | AAV7, AAV11 | AAV8, AAV12 | AAV9, AAVRH8 | AAV10, AAVRH10 |
| AAV6, AAV11 | AAV7, AAV12 | AAV8, AAVRH8 | AAV9, AAVRH10 | AAV10, AAV13 |
| AAV6, AAV12 | AAV7, AAVRH8 | AAV8, AAVRH10 | AAV9, AAV13 | AAV10, AAVDJ |
| AAV6, AAVRH8 | AAV7, AAVRH10 | AAV8, AAV13 | AAV9, AAVDJ | AAV10, AAVDJ8 |
| AAV6, AAVRH10 | AAV7, AAV13 | AAV8, AAVDJ | AAV9, AAVDJ8 | AAV10, AVIAN |
| AAV6, AAV13 | AAV7, AAVDJ | AAV8, AAVDJ8 | AAV9, AVIAN | AAV10, BOVINE |
| AAV6, AAVDJ | AAV7, AAVDJ8 | AAV8, AVIAN | AAV9, BOVINE | AAV10, CANINE |
| AAV6, AAVDJ8 | AAV7, AVIAN | AAV8, BOVINE | AAV9, CANINE | AAV10, EQUINE |
| AAV6, AVIAN | AAV7, BOVINE | AAV8, CANINE | AAV9, EQUINE | AAV10, GOAT |
| AAV6, BOVINE | AAV7, CANINE | AAV8, EQUINE | AAV9, GOAT | AAV10, SHRIMP |
| AAV6, CANINE | AAV7, EQUINE | AAV8, GOAT | AAV9, SHRIMP | AAV10, PORCINE |
| AAV6, EQUINE | AAV7, GOAT | AAV8, SHRIMP | AAV9, PORCINE | AAV10, INSECT |
| AAV6, GOAT | AAV7, SHRIMP | AAV8, PORCINE | AAV9, INSECT | AAV10, OVINE |
| AAV6, SHRIMP | AAV7, PORCINE | AAV8, INSECT | AAV9, OVINE | AAV10, B19 |
| AAV6, PORCINE | AAV7, INSECT | AAV8, OVINE | AAV9, B19 | AAV10, MVM |
| AAV6, INSECT | AAV7, OVINE | AAV8, B19 | AAV9, MVM | AAV10, GOOSE |
| AAV6, OVINE | AAV7, B19 | AAV8, MVM | AAV9, GOOSE | AAV10, SNAKE |
| AAV6, B19 | AAV7, MVM | AAV8, GOOSE | AAV9, SNAKE | |
| AAV6, MVM | AAV7, GOOSE | AAV8, SNAKE | | |
| AAV6, GOOSE | AAV7, SNAKE | | | |
| AAV6, SNAKE | | | | |
| AAV11, AAV11 | AAV12, AAV12 | AAVRH8, AAVRH8 | AAVRH10, AAVRH10 | AAV13, AAV13 |
| AAV11, AAV12 | AAV12, AAVRH8 | AAVRH8, AAVRH10 | AAVRH10, AAV13 | AAV13, AAVDJ |

TABLE 2-continued

| | | | | |
|---|---|---|---|---|
| AAV11, AAVRH8 | AAV12, AAVRH10 | AAVRH8, AAV13 | AAVRH10, AAVDJ | AAV13, AAVDJ8 |
| AAV11, AAVRH10 | AAV12, AAV13 | AAVRH8, AAVDJ | AAVRH10, AAVDJ8 | AAV13, AVIAN |
| AAV11, AAV13 | AAV12, AAVDJ | AAVRH8, AAVDJ8 | AAVRH10, AVIAN | AAV13, BOVINE |
| AAV11, AAVDJ | AAV12, AAVDJ8 | AAVRH8, AVIAN | AAVRH10, BOVINE | AAV13, CANINE |
| AAV11, AAVDJ8 | AAV12, AVIAN | AAVRH8, BOVINE | AAVRH10, CANINE | AAV13, EQUINE |
| AAV11, AVIAN | AAV12, BOVINE | AAVRH8, CANINE | AAVRH10, EQUINE | AAV13, GOAT |
| AAV11, BOVINE | AAV12, CANINE | AAVRH8, EQUINE | AAVRH10, GOAT | AAV13, SHRIMP |
| AAV11, CANINE | AAV12, EQUINE | AAVRH8, GOAT | AAVRH10, SHRIMP | AAV13, PORCINE |
| AAV11, EQUINE | AAV12, GOAT | AAVRH8, SHRIMP | AAVRH10, PORCINE | AAV13, INSECT |
| AAV11, GOAT | AAV12, SHRIMP | AAVRH8, PORCINE | AAVRH10, INSECT | AAV13, OVINE |
| AAV11, SHRIMP | AAV12, PORCINE | AAVRH8, INSECT | AAVRH10, OVINE | AAV13, B19 |
| AAV11, PORCINE | AAV12, INSECT | AAVRH8, OVINE | AAVRH10, B19 | AAV13, MVM |
| AAV11, INSECT | AAV12, OVINE | AAVRH8, B19 | AAVRH10, MVM | AAV13, GOOSE |
| AAV11, OVINE | AAV12, B19 | AAVRH8, MVM | AAVRH10, GOOSE | AAV13, SNAKE |
| AAV11, B19 | AAV12, MVM | AAVRH8, GOOSE | AAVRH10, SNAKE | |
| AAV11, MVM | AAV12, GOOSE | AAVRH8, SNAKE | | |
| AAV11, GOOSE | AAV12, SNAKE | | | |
| AAV11, SNAKE | | | | |
| AAVDJ, AAVDJ | AAVDJ8, AVVDJ8 | AVIAN, AVIAN | BOVINE, BOVINE | CANINE, CANINE |
| AAVDJ, AAVDJ8 | AAVDJ8, AVIAN | AVIAN, BOVINE | BOVINE, CANINE | CANINE, EQUINE |
| AAVDJ, AVIAN | AAVDJ8, BOVINE | AVIAN, CANINE | BOVINE, EQUINE | CANINE, GOAT |
| AAVDJ, BOVINE | AAVDJ8, CANINE | AVIAN, EQUINE | BOVINE, GOAT | CANINE, SHRIMP |
| AAVDJ, CANINE | AAVDJ8, EQUINE | AVIAN, GOAT | BOVINE, SHRIMP | CANINE, PORCINE |
| AAVDJ, EQUINE | AAVDJ8, GOAT | AVIAN, SHRIMP | BOVINE, PORCINE | CANINE, INSECT |
| AAVDJ, GOAT | AAVDJ8, SHRIMP | AVIAN, PORCINE | BOVINE, INSECT | CANINE, OVINE |
| AAVDJ, SHRIMP | AAVDJ8, PORCINE | AVIAN, INSECT | BOVINE, OVINE | CANINE, B19 |
| AAVDJ, PORCINE | AAVDJ8, INSECT | AVIAN, OVINE | BOVINE, B19 | CANINE, MVM |
| AAVDJ, INSECT | AAVDJ8, OVINE | AVIAN, B19 | BOVINE, MVM | CANINE, GOOSE |
| AAVDJ, OVINE | AAVDJ8, B19 | AVIAN, MVM | BOVINE, GOOSE | CANINE, SNAKE |
| AAVDJ, B19 | AAVDJ8, MVM | AVIAN, GOOSE | BOVINE, SNAKE | |
| AAVDJ, MVM | AAVDJ8, GOOSE | AVIAN, SNAKE | | |
| AAVDJ, GOOSE | AAVDJ8, SNAKE | | | |
| AAVDJ, SNAKE | | | | |
| EQUINE, EQUINE | GOAT, GOAT | SHRIMP, SHRIMP | PORCINE, PORCINE | INSECT, INSECT |
| EQUINE, GOAT | GOAT, SHRIMP | SHRIMP, PORCINE | PORCINE, INSECT | INSECT, OVINE |
| EQUINE, SHRIMP | GOAT, PORCINE | SHRIMP, INSECT | PORCINE, OVINE | INSECT, B19 |
| EQUINE, PORCINE | GOAT, INSECT | SHRIMP, OVINE | PORCINE, B19 | INSECT, MVM |
| EQUINE, INSECT | GOAT, OVINE | SHRIMP, B19 | PORCINE, MVM | INSECT, GOOSE |
| EQUINE, OVINE | GOAT, B19 | SHRIMP, MVM | PORCINE, GOOSE | INSECT, SNAKE |
| EQUINE, B19 | GOAT, MVM | SHRIMP, GOOSE | PORCINE, SNAKE | |
| EQUINE, MVM | GOAT, GOOSE | SHRIMP, SNAKE | | |
| EQUINE, GOOSE | GOAT, SNAKE | | | |
| EQUINE, SNAKE | | | | |
| OVINE, OVINE | B19, B19 | MVM, MVM | GOOSE, GOOSE | SNAKE, SNAKE |
| OVINE, B19 | B19, MVM | MVM, GOOSE | GOOSE, SNAKE | |
| OVINE, MVM | B19, GOOSE | MVM, SNAKE | | |
| OVINE, GOOSE | B19, SNAKE | | | |
| OVINE, SNAKE | | | | |

By way of example only, Table 3 shows the sequences of exemplary WT-ITRs from some different AAV serotypes.

TABLE 3

| AAV serotype | 5' WT-ITR (LEFT) | 3' WT-ITR (RIGHT) |
|---|---|---|
| AAV1 | 5'-<br>TTGCCCACTCCCTCTCTGCGCGCTCGC<br>TCGCTCGGTGGGGCCTGCGGACCAAA<br>GGTCCGCAGACGGCAGAGGTCTCCTCT<br>GCCGGCCCCACCGAGCGAGCGACGCG<br>CGCAGAGAGGGAGTGGGCAACTCCAT<br>CACTAGGGTAA-3'<br>(SEQ ID NO: 5) | 5'-<br>TTACCCTAGTGATGGAGTTGCCCACTC<br>CCTCTCTGCGCGCGTCGCTCGCTCGGT<br>GGGGCCGGCAGAGGAGACCTCTGCCG<br>TCTGCGGACCTTTGGTCCGCAGGCCCC<br>ACCGAGCGAGCGAGCGCGCAGAGAGG<br>GAGTGGGCAA-3' (SEQ ID NO: 10) |
| AAV2 | CCTGCAGGCAGCTGCGCGCTCGCTCGC<br>TCACTGAGGCCGCCCGGGCAAAGCCC<br>GGGCGTCGGGCGACCTTTGGTCGCCCG<br>GCCTCAGTGAGCGAGCGAGCGCGCAG<br>AGAGGGAGTGGCCAACTCCATCACTA<br>GGGGTTCCT (SEQ ID NO: 2) | AGGAACCCCTAGTGATGGAGTTGGCCA<br>CTCCCTCTCTGCGCGCTCGCTCGCTCAC<br>TGAGGCCGGGCGACCAAAGGTCGCCC<br>GACGCCCGGGCTTTGCCCGGGCGGCCT<br>CAGTGAGCGAGCGAGCGCGCAGCTGC<br>CTGCAGG (SEQ ID NO: 1) |
| AAV3 | 5'-<br>TTGGCCACTCCCTCTATGCGCACTCGC<br>TCGCTCGGTGGGGCCTGGCGACCAAA<br>GGTCGCCAGACGGACGTGGGTTTCCAC | 5'-<br>ATACCTCTAGTGATGGAGTTGGCCACT<br>CCCTCTATGCGCACTCGCTCGCTCGGT<br>GGGGCCGGACGTGGAAACCCACGTCC |

TABLE 3-continued

| AAV serotype | 5' WT-ITR (LEFT) | 3' WT-ITR (RIGHT) |
|---|---|---|
| | GTCCGGCCCCACCGAGCGAGCGAGTG CGCATAGAGGGAGTGGCCAACTCCAT CACTAGAGGTAT-3' (SEQ ID NO: 6) | GTCTGGCGACCTTTGGTCGCCAGGCCC CACCGAGCGAGCGAGTGCGCATAGAG GGAGTGGCCAA-3' (SEQ ID NO: 11) |
| AAV4 | 5'- TTGGCCACTCCCTCTATGCGCGCTCGC TCACTCACTCGGCCCTGGAGACCAAAG GTCTCCAGACTGCCGGCCTCTGGCCGG CAGGGCCGAGTGAGTGAGCGAGCGCG CATAGAGGGAGTGGCCAACT-3' (SEQ ID NO: 7) | 5'- AGTTGGCCACATTAGCTATGCGCGCTC GCTCACTCACTCGGCCCTGGAGACCAA AGGTCTCCAGACTGCCGGCCTCTGGCC GGCAGGGCCGAGTGAGTGAGCGAGCG CGCATAGAGGGAGTGGCCAA-3' (SEQ ID NO: 12) |
| AAV5 | 5'- TCCCCCCTGTCGCGTTCGCTCGCTCGC TGGCTCGTTTGGGGGGGCGACGGCCA GAGGGCCGTCGTCTGGCAGCTCTTTGA GCTGCCACCCCCCCAAACGAGCCAGC GAGCGAGCGAACGCGACAGGGGGGAG AGTGCCACACTCTCAAGCAAGGGGGT TTTGTAAG-3' (SEQ ID NO: 8) | 5'- CTTACAAAACCCCCTTGCTTGAGAGTG TGGCACTCTCCCCCCTGTCGCGTTCGCT CGCTCGCTGGCTCGTTTGGGGGGGTGG CAGCTCAAAGAGCTGCCAGACGACGG CCCTCTGGCCGTCGCCCCCCCAAACGA GCCAGCGAGCGAGCGAACGCGACAGG GGGGA-3' (SEQ ID NO: 13) |
| AAV6 | 5'- TTGCCCACTCCCTCTAATGCGCGCTCG CTCGCTCGGTGGGGCCTGCGGACCAA AGGTCCGCAGACGGCAGAGGTCTCCT CTGCCGGCCCCACCGAGCGAGCGAGC GCGCATAGAGGGAGTGGGCAACTCCA TCACTAGGGGTAT-3' (SEQ ID NO: 9) | 5'- ATACCCCTAGTGATGGAGTTGCCCACT CCCTCTATGCGCGCTCGCTCGCTCGGT GGGGCCGGCAGAGGAGACCTCTGCCG TCTGCGGACCTTTGGTCCGCAGGCCCC ACCGAGCGAGCGAGCGCGCATTAGAG GGAGTGGGCAA (SEQ ID NO: 14) |

In some embodiments, the nucleotide sequence of the WT-ITR sequence can be modified (e.g., by modifying 1, 2, 3, 4 or 5, or more nucleotides or any range therein), whereby the modification is a substitution for a complementary nucleotide, e.g., G for a C, and vice versa, and T for an A, and vice versa.

In certain embodiments of the present invention, the ceDNA vector for expression of FVIII protein does not have a WT-ITR consisting of the nucleotide sequence selected from any of: SEQ ID NOs: 1, 2, 5-14. In alternative embodiments of the present invention, if a ceDNA vector has a WT-ITR comprising the nucleotide sequence selected from any of: SEQ ID NOs: 1, 2, 5-14, then the flanking ITR is also WT and the ceDNA vector comprises a regulatory switch, e.g., as disclosed herein and in International application PCT/US18/49996 (e.g., see Table 11 of PCT/US18/49996). In some embodiments, the ceDNA vector for expression of FVIII protein comprises a regulatory switch as disclosed herein and a WT-ITR selected having the nucleotide sequence selected from any of the group consisting of: SEQ ID NO: 1, 2, 5-14.

Figure 2A:
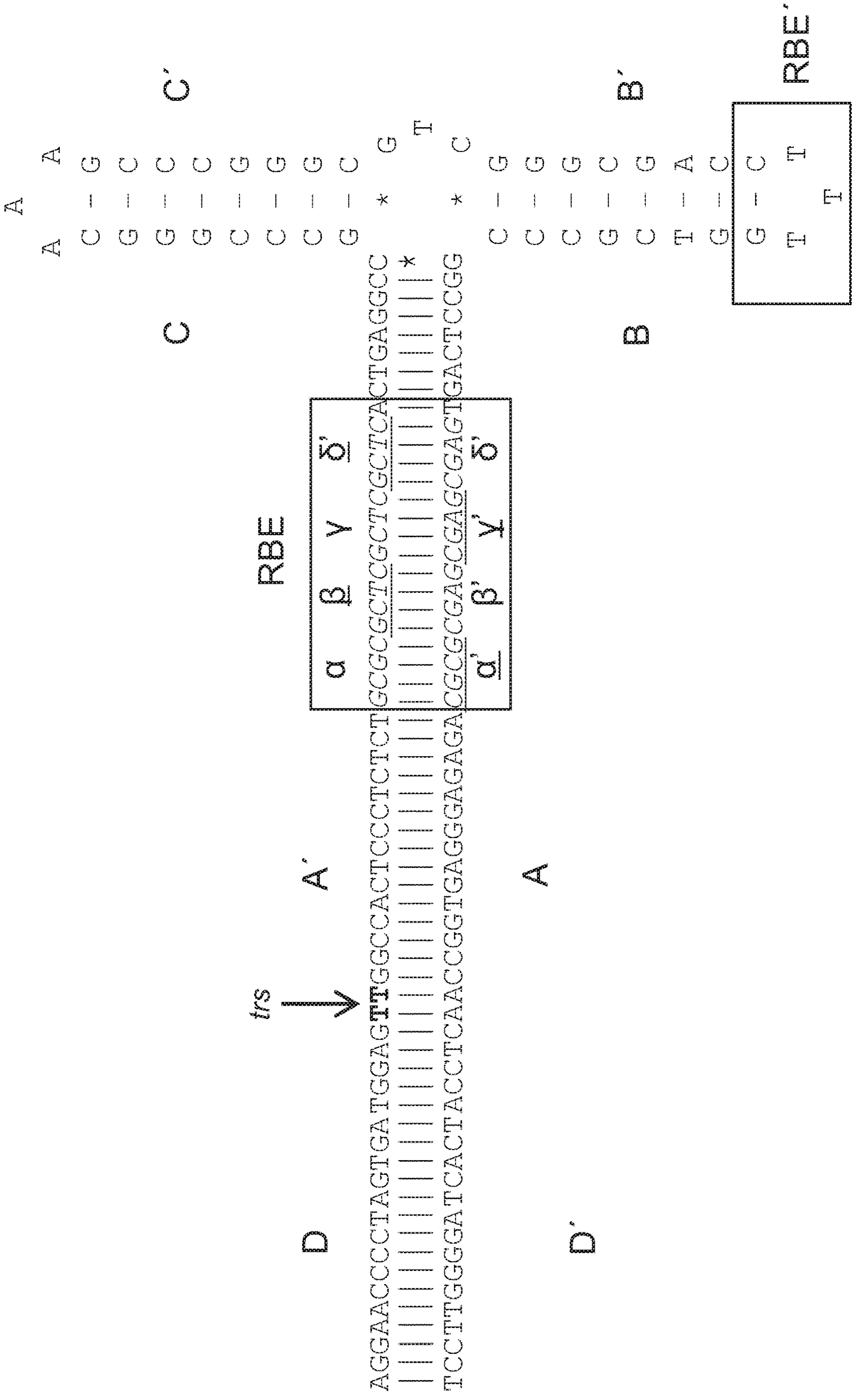
FIG. 2A provides the T-shaped stem-loop structure of a wild-type left ITR of AAV2 (SEQ ID NO: 52) with identification of A-A' arm, B-B' arm, C-C' arm, two Rep binding sites (RBE and RBE') and also shows the terminal resolution site (TRS). The RBE contains a series of 4 duplex tetramers that are believed to interact with either Rep 78 or Rep 68. In addition, the RBE' is also believed to interact with Rep complex assembled on the wild-type ITR or mutated ITR in the construct. The D and D' regions contain transcription factor binding sites and other conserved structure.
Figure 2B:
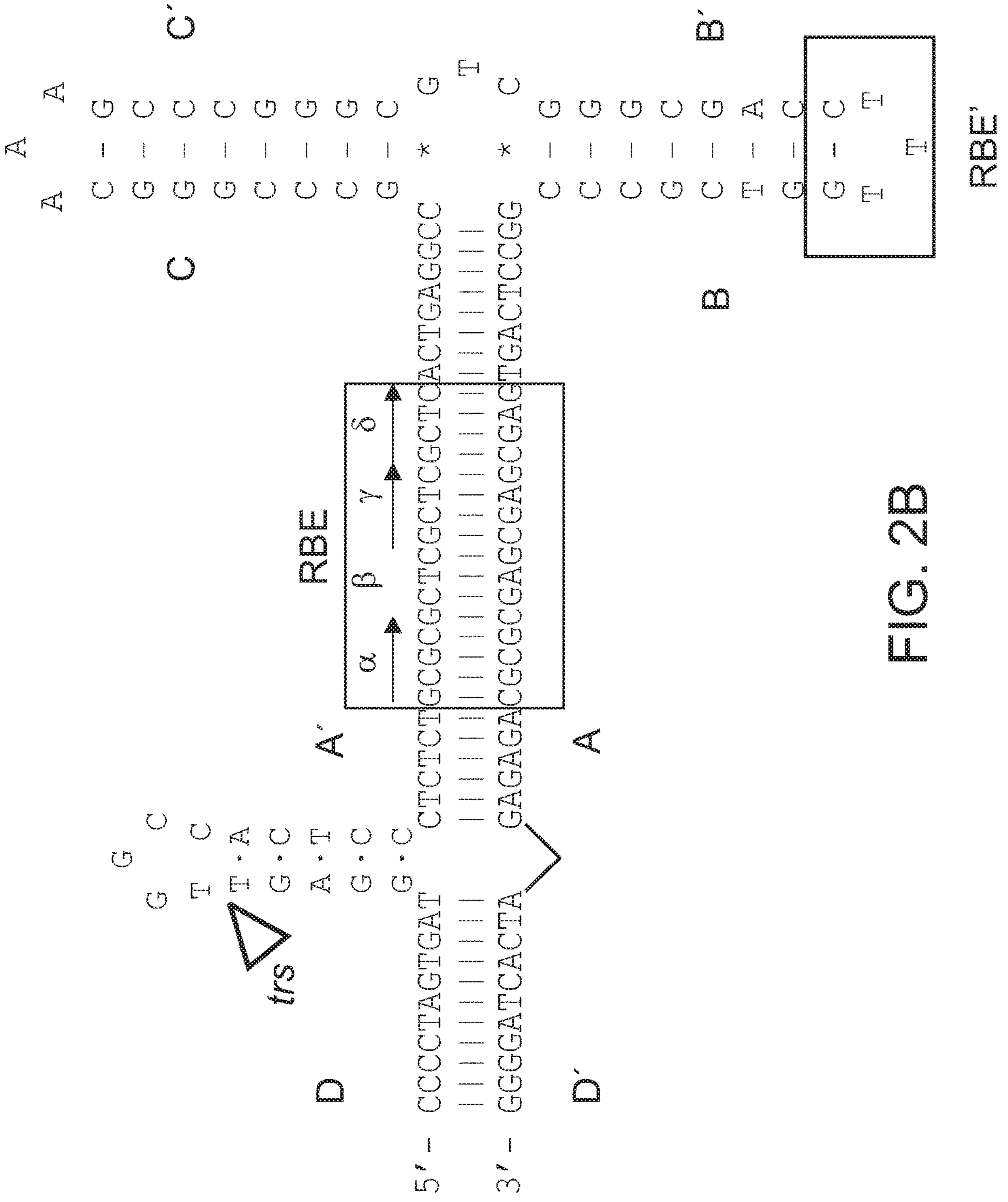
FIG. 2B shows proposed Rep-catalyzed nicking and ligating activities in a wild-type left ITR (SEQ ID NO: 53), including the T-shaped stem-loop structure of the wild-type left ITR of AAV2 with identification of A-A' arm, B-B' arm, C-C' arm, two Rep Binding sites (RBE and RBE') and also shows the terminal resolution site (TRS), and the D and D' region comprising several transcription factor binding sites and other conserved structure.
Figure 3A:
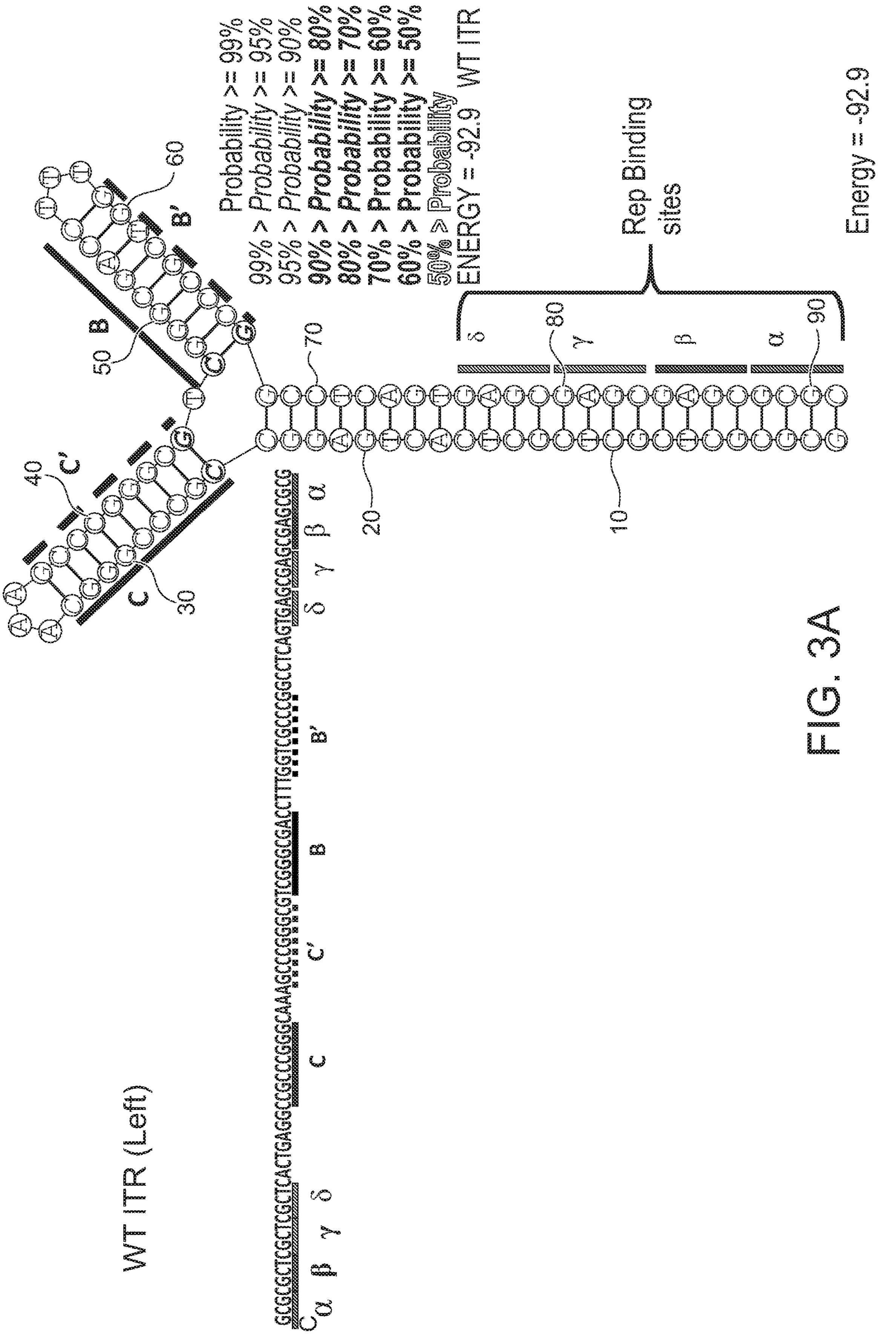
FIG. 3A provides the primary structure (polynucleotide sequence) (left) and the secondary structure (right) of the RBE-containing portions of the A-A' arm, and the C-C' and B-B' arm of the wild type left AAV2 ITR (SEQ ID NO: 54).

The ceDNA vector for expression of FVIII protein as described herein can include WT-ITR structures that retains an operable RBE, TRS and RBE' portion. FIG. 2A and FIG. 2B, using wild-type ITRs for exemplary purposes, show one possible mechanism for the operation of a TRS site within a wild type ITR structure portion of a ceDNA vector. In some embodiments, the ceDNA vector for expression of FVIII protein contains one or more functional WT-ITR polynucleotide sequences that comprise a Rep-binding site (RBS; 5'-GCGCGCTCGCTCGCTC-3' (SEQ ID NO: 60) for AAV2) and a terminal resolution site (TRS; 5'-AGTT (SEQ ID NO: 62)). In some embodiments, at least one WT-ITR is functional. In alternative embodiments, where a ceDNA vector for expression of FVIII protein comprises two WT-ITRs that are substantially symmetrical to each other, at least one WT-ITR is functional and at least one WT-ITR is non-functional.

B. Modified ITRs (Mod-ITRs) in General for ceDNA Vectors Comprising Asymmetric ITR Pairs or Symmetric ITR Pairs As discussed herein, a ceDNA vector for expression of FVIII protein can comprise a symmetrical ITR pair or an asymmetrical ITR pair. In both instances, one or both of the ITRs can be modified ITRs—the difference being that in the first instance (i.e., symmetric mod-ITRs), the mod-ITRs have the same three-dimensional spatial organization (i.e., have the same A-A', C-C' and B-B' arm configurations), whereas in the second instance (i.e., asymmetric mod-ITRs), the mod-ITRs have a different three-dimensional spatial organization (i.e., have a different configuration of A-A', C-C' and B-B' arms).

In some embodiments, a modified ITR is an ITRs that is modified by deletion, insertion, and/or substitution as compared to a wild-type ITR sequence (e.g. AAV ITR). In some embodiments, at least one of the ITRs in the ceDNA vector comprises a functional Rep binding site (RBS; e.g. 5'-GCGCGCTCGCTCGCTC-3' for AAV2, SEQ ID NO: 60) and a functional terminal resolution site (TRS; e.g. 5'-AGTT-3', SEQ ID NO: 62.) In one embodiment, at least one of the ITRs is a non-functional ITR. In one embodiment, the different or modified ITRs are not each wild type ITRs from different serotypes.

Specific alterations and mutations in the ITRs are described in detail herein, but in the context of ITRs, "altered" or "mutated" or "modified", it indicates that nucleotides have been inserted, deleted, and/or substituted relative to the wild-type, reference, or original ITR sequence. The altered or mutated ITR can be an engineered ITR. As used herein, "engineered" refers to the aspect of having been manipulated by the hand of man. For example, a polypeptide is considered to be "engineered" when at least one aspect of the polypeptide, e.g., its sequence, has been manipulated by the hand of man to differ from the aspect as it exists in nature.

In some embodiments, a mod-ITR may be synthetic. In one embodiment, a synthetic ITR is based on ITR sequences from more than one AAV serotype. In another embodiment, a synthetic ITR includes no AAV-based sequence. In yet another embodiment, a synthetic ITR preserves the ITR structure described above although having only some or no AAV-sourced sequence. In some aspects, a synthetic ITR may interact preferentially with a wild type Rep or a Rep of a specific serotype, or in some instances will not be recognized by a wild-type Rep and be recognized only by a mutated Rep.

The skilled artisan can determine the corresponding sequence in other serotypes by known means. For example, determining if the change is in the A, A', B, B', C, C' or D region and determine the corresponding region in another serotype. One can use BLAST® (Basic Local Alignment Search Tool) or other homology alignment programs at default status to determine the corresponding sequence. The invention further provides populations and pluralities of ceDNA vectors comprising mod-ITRs from a combination of different AAV serotypes—that is, one mod-ITR can be from one AAV serotype and the other mod-ITR can be from a different serotype. Without wishing to be bound by theory, in one embodiment one ITR can be from or based on an AAV2 ITR sequence and the other ITR of the ceDNA vector can be from or be based on any one or more ITR sequence of AAV serotype 1 (AAV1), AAV serotype 4 (AAV4), AAV serotype 5 (AAV5), AAV serotype 6 (AAV6), AAV serotype 7 (AAV7), AAV serotype 8 (AAV8), AAV serotype 9 (AAV9), AAV serotype 10 (AAV10), AAV serotype 11 (AAV11), or AAV serotype 12 (AAV12).

Any parvovirus ITR can be used as an ITR or as a base ITR for modification. Preferably, the parvovirus is a dependovirus. More preferably AAV. The serotype chosen can be based upon the tissue tropism of the serotype. AAV2 has a broad tissue tropism, AAV1 preferentially targets to neuronal and skeletal muscle, and AAV5 preferentially targets neuronal, retinal pigmented epithelia, and photoreceptors. AAV6 preferentially targets skeletal muscle and lung. AAV8 preferentially targets liver, skeletal muscle, heart, and pancreatic tissues. AAV9 preferentially targets liver, skeletal and lung tissue. In one embodiment, the modified ITR is based on an AAV2 ITR.

More specifically, the ability of a structural element to functionally interact with a particular large Rep protein can be altered by modifying the structural element. For example, the nucleotide sequence of the structural element can be modified as compared to the wild-type sequence of the ITR. In one embodiment, the structural element (e.g., A arm, A' arm, B arm, B' arm, C arm, C' arm, D arm, RBE, RBE', and TRS) of an ITR can be removed and replaced with a wild-type structural element from a different parvovirus. For example, the replacement structure can be from AAV1, AAV2, AAV3, AAV4, AAV5, AAV6, AAV7, AAV8, AAV9, AAV10, AAV11, AAV12, AAV13, snake parvovirus (e.g., royal python parvovirus), bovine parvovirus, goat parvovirus, avian parvovirus, canine parvovirus, equine parvovirus, shrimp parvovirus, porcine parvovirus, or insect AAV. For example, the ITR can be an AAV2 ITR and the A or A' arm or RBE can be replaced with a structural element from AAV5. In another example, the ITR can be an AAV5 ITR and the C or C' arms, the RBE, and the TRS can be replaced with a structural element from AAV2. In another example, the AAV ITR can be an AAV5 ITR with the B and B' arms replaced with the AAV2 ITR B and B' arms.

By way of example only, Table 4 indicates exemplary modifications of at least one nucleotide (e.g., a deletion, insertion and/or substitution) in regions of a modified ITR, where X is indicative of a modification of at least one nucleic acid (e.g., a deletion, insertion and/or substitution) in that section relative to the corresponding wild-type ITR. In some embodiments, any modification of at least one nucleotide (e.g., a deletion, insertion and/or substitution) in any of the regions of C and/or C' and/or B and/or B' retains three sequential T nucleotides (i.e., TTT) in at least one terminal loop. For example, if the modification results in any of: a single arm ITR (e.g., single C-C' arm, or a single B-B' arm), or a modified C-B' arm or C'-B arm, or a two arm ITR with at least one truncated arm (e.g., a truncated C-C' arm and/or truncated B-B' arm), at least the single arm, or at least one of the arms of a two arm ITR (where one arm can be truncated) retains three sequential T nucleotides (i.e., TTT) in at least one terminal loop. In some embodiments, a truncated C-C' arm and/or a truncated B-B' arm has three sequential T nucleotides (i.e., TTT) in the terminal loop.

TABLE 4

Exemplary combinations of modifications of at least one nucleotide (e.g., a deletion, insertion and/or substitution) to different B-B' and C-C' regions or arms of ITRs (X indicates a nucleotide modification, e.g., addition, deletion or substitution of at least one nucleotide in the region).

| B region | B' region | C region | C' region |
|---|---|---|---|
| X | | | |
| | X | | |
| X | X | | |
| | | X | |
| | | | X |
| | | X | X |
| X | | X | |
| X | | | X |
| | X | X | |
| | X | | X |
| X | X | X | |
| X | X | | X |
| X | | X | X |
| | X | X | X |
| X | X | X | X |

In some embodiments, mod-ITR for use in a ceDNA vector for expression of FVIII protein comprises an asymmetric ITR pair, or a symmetric mod-ITR pair as disclosed herein, can comprise any one of the combinations of modifications shown in Table 4, and also a modification of at least one nucleotide in any one or more of the regions selected from: between A' and C, between C and C', between C' and B, between B and B' and between B' and A. In some embodiments, any modification of at least one nucleotide (e.g., a deletion, insertion and/or substitution) in the C or C' or B or B' regions, still preserves the terminal loop of the stem-loop. In some embodiments, any modification of at least one nucleotide (e.g., a deletion, insertion and/or substitution) between C and C' and/or B and B' retains three sequential T nucleotides (i.e., TTT) in at least one terminal loop. In alternative embodiments, any modification of at least one nucleotide (e.g., a deletion, insertion and/or substitution) between C and C' and/or B and B' retains three sequential A nucleotides (i.e., AAA) in at least one terminal loop. In some embodiments, a modified ITR for use herein can comprise any one of the combinations of modifications shown in Table 4, and also a modification of at least one nucleotide (e.g., a deletion, insertion and/or substitution) in any one or more of the regions selected from: A', A and/or D. For example, in some embodiments, a modified ITR for use herein can comprise any one of the combinations of modifications shown in Table 4, and also a modification of at least one nucleotide (e.g., a deletion, insertion and/or substitution) in the A region. In some embodiments, a modified ITR for use herein can comprise any one of the combinations of modifications shown in Table 4, and also a modification of at least one nucleotide (e.g., a deletion, insertion and/or substitution) in the A' region. In some embodiments, a modified ITR for use herein can comprise any one of the combinations of modifications shown in Table 4, and also a modification of at least one nucleotide (e.g., a deletion, insertion and/or substitution) in the A and/or A' region. In some embodiments, a modified ITR for use herein can comprise any one of the combinations of modifications shown in Table 4, and also a modification of at least one nucleotide (e.g., a deletion, insertion and/or substitution) in the D region.

In one embodiment, the nucleotide sequence of the structural element can be modified (e.g., by modifying 1, 2, 3, 4, 5, 6, 7, 8, 9, 10, 11, 12, 13, 14, 15, 16, 17, 18, 19, or 20 or more nucleotides or any range therein) to produce a modified structural element. In one embodiment, the specific modifications to the ITRs are exemplified herein (e.g., SEQ ID NOS: 3, 4, 15-47, 101-116 or 165-187, or shown in FIG. 7A-7B of PCT/US2018/064242, filed on Dec. 6, 2018 (e.g., SEQ ID Nos 97-98, 101-103, 105-108, 111-112, 117-134, 545-54 in PCT/US2018/064242). In some embodiments, an ITR can be modified (e.g., by modifying 1, 2, 3, 4, 5, 6, 7, 8, 9, 10, 11, 12, 13, 14, 15, 16, 17, 18, 19, or 20 or more nucleotides or any range therein). In other embodiments, the ITR can have at least 80%, at least 85%, at least 90%, at least 95%, at least 96%, at least 97%, at least 98%, at least 99%, or more sequence identity with one of the modified ITRs of SEQ ID NOS: 3, 4, 15-47, 101-116 or 165-187, or the RBE-containing section of the A-A' arm and C-C' and B-B' arms of SEQ ID NO: 3, 4, 15-47, 101-116 or 165-187, or shown in Tables 2-9 (i.e., SEQ ID NO: 110-112, 115-190, 200-468) of International application PCT/US18/49996, which is incorporated herein in its entirety by reference.

Figure 3B:
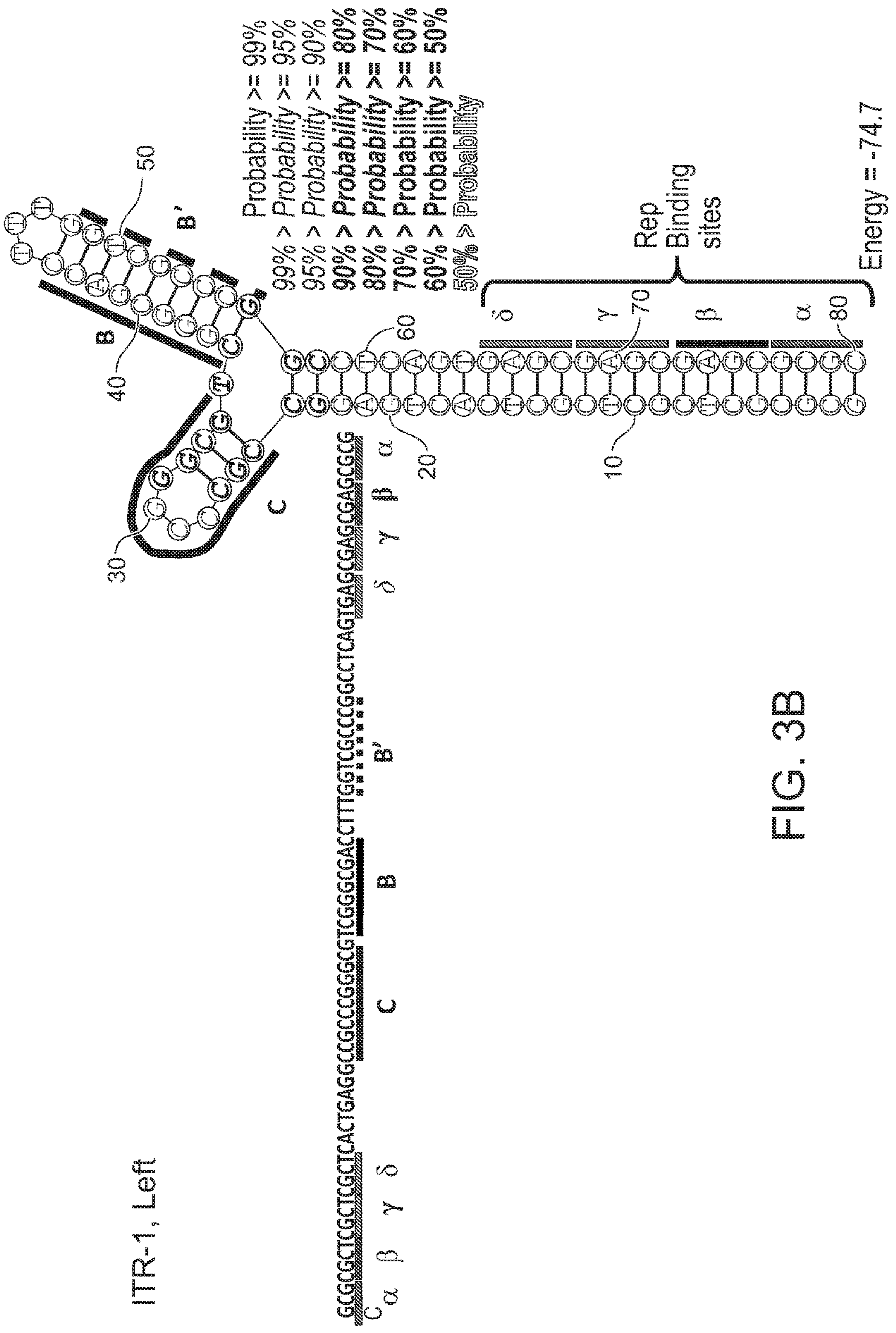
FIG. 3B shows an exemplary mutated ITR (also referred to as a modified ITR) sequence for the left ITR. Shown is the primary structure (left) and the predicted secondary structure (right) of the RBE portion of the A-A' arm, the C arm and B-B' arm of an exemplary mutated left ITR (ITR-1, left) (SEQ ID NO: 113).

In some embodiments, a modified ITR can for example, comprise removal or deletion of all of a particular arm, e.g., all or part of the A-A' arm, or all or part of the B-B' arm or all or part of the C-C' arm, or alternatively, the removal of 1, 2, 3, 4, 5, 6, 7, 8, 9 or more base pairs forming the stem of the loop so long as the final loop capping the stem (e.g., single arm) is still present (e.g., see ITR-21 in FIG. 7A of PCT/US2018/064242, filed Dec. 6, 2018). In some embodiments, a modified ITR can comprise the removal of 1, 2, 3, 4, 5, 6, 7, 8, 9 or more base pairs from the B-B' arm. In some embodiments, a modified ITR can comprise the removal of 1, 2, 3, 4, 5, 6, 7, 8, 9 or more base pairs from the C-C' arm (see, e.g., ITR-1 in FIG. 3B, or ITR-45 in FIG. 7A of PCT/US2018/064242, filed Dec. 6, 2018). In some embodiments, a modified ITR can comprise the removal of 1, 2, 3, 4, 5, 6, 7, 8, 9 or more base pairs from the C-C' arm and the removal of 1, 2, 3, 4, 5, 6, 7, 8, 9 or more base pairs from the B-B' arm. Any combination of removal of base pairs is envisioned, for example, 6 base pairs can be removed in the C-C' arm and 2 base pairs in the B-B' arm. As an illustrative example, FIG. 3B shows an exemplary modified ITR with at least 7 base pairs deleted from each of the C portion and the C' portion, a substitution of a nucleotide in the loop between C and C' region, and at least one base pair deletion from each of the B region and B' regions such that the modified ITR comprises two arms where at least one arm (e.g., C-C') is truncated. In some embodiments, the modified ITR also comprises at least one base pair deletion from each of the B region and B' regions, such that the B-B' arm is also truncated relative to WT ITR.

In some embodiments, a modified ITR can have between 1 and 50 (e.g. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50) nucleotide deletions relative to a full-length wild-type ITR sequence. In some embodiments, a modified ITR can have between 1 and 30 nucleotide deletions relative to a full-length WT ITR sequence. In some embodiments, a modified ITR has between 2 and 20 nucleotide deletions relative to a full-length wild-type ITR sequence.

In some embodiments, a modified ITR does not contain any nucleotide deletions in the RBE-containing portion of the A or A' regions, so as not to interfere with DNA replication (e.g. binding to an RBE by Rep protein, or nicking at a terminal resolution site). In some embodiments, a modified ITR encompassed for use herein has one or more deletions in the B, B', C, and/or C region as described herein.

In some embodiments, a ceDNA vector for expression of FVIII protein comprising a symmetric ITR pair or asymmetric ITR pair comprises a regulatory switch as disclosed herein and at least one modified ITR selected having the nucleotide sequence selected from any of the group consisting of: SEQ ID NO: 3, 4, 15-47, 101-116 or 165-187.

In another embodiment, the structure of the structural element can be modified. For example, the structural element a change in the height of the stem and/or the number of nucleotides in the loop. For example, the height of the stem can be about 2, 3, 4, 5, 6, 7, 8, or 9 nucleotides or more or any range therein. In one embodiment, the stem height can be about 5 nucleotides to about 9 nucleotides and functionally interacts with Rep. In another embodiment, the stem height can be about 7 nucleotides and functionally interacts with Rep. In another example, the loop can have 3, 4, 5, 6, 7, 8, 9, or 10 nucleotides or more or any range therein.

In another embodiment, the number of GAGY binding sites or GAGY-related binding sites within the RBE or extended RBE can be increased or decreased. In one example, the RBE or extended RBE, can comprise 1, 2, 3, 4, 5, or 6 or more GAGY binding sites or any range therein. Each GAGY binding site can independently be an exact GAGY sequence or a sequence similar to GAGY as long as the sequence is sufficient to bind a Rep protein.

In another embodiment, the spacing between two elements (such as but not limited to the RBE and a hairpin) can be altered (e.g., increased or decreased) to alter functional interaction with a large Rep protein. For example, the spacing can be about 1, 2, 3, 4, 5, 6, 7, 8, 9, 10, 11, 12, 13, 14, 15, 16, 17, 18, 19, 20, or 21 nucleotides or more or any range therein.

The ceDNA vector for expression of FVIII protein as described herein can include an ITR structure that is modified with respect to the wild type AAV2 ITR structure disclosed herein, but still retains an operable RBE, TRS and RBE' portion. FIG. 2A and FIG. 2B show one possible mechanism for the operation of a TRS site within a wild type ITR structure portion of a ceDNA vector for expression of FVIII protein. In some embodiments, the ceDNA vector for expression of FVIII protein contains one or more functional ITR polynucleotide sequences that comprise a Rep-binding site (RBS; 5'-GCGCGCTCGCTCGCTC-3' (SEQ ID NO: 60) for AAV2) and a terminal resolution site (TRS; 5'-AGTT (SEQ ID NO: 62)). In some embodiments, at least one ITR (wt or modified ITR) is functional. In alternative embodiments, where a ceDNA vector for expression of FVIII protein comprises two modified ITRs that are different or asymmetrical to each other, at least one modified ITR is functional and at least one modified ITR is non-functional.

In some embodiments, the modified ITR (e.g., the left or right ITR) of a ceDNA vector for expression of FVIII protein as described herein has modifications within the loop arm, the truncated arm, or the spacer. Exemplary sequences of ITRs having modifications within the loop arm, the truncated arm, or the spacer are listed in Table 2 (i.e., SEQ ID NOS: 135-190, 200-233); Table 3 (e.g., SEQ ID Nos: 234-263); Table 4 (e.g., SEQ ID NOs: 264-293); Table 5 (e.g., SEQ ID Nos: 294-318 herein); Table 6 (e.g., SEQ ID NO: 319-468; and Tables 7-9 (e.g., SEQ ID Nos: 101-110, 111-112, 115-134) or Table 10A or 10B (e.g., SEQ ID Nos: 9, 100, 469-483, 484-499) of International application PCT/US18/49996, which is incorporated herein in its entirety by reference.

In some embodiments, the modified ITR for use in a ceDNA vector for expression of FVIII protein comprising an asymmetric ITR pair, or symmetric mod-ITR pair is selected from any or a combination of those shown in Tables 2, 3, 4, 5, 6, 7, 8, 9 and 10A-10B of International application PCT/US18/49996 which is incorporated herein in its entirety by reference.

Additional exemplary modified ITRs for use in a ceDNA vector for expression of FVIII protein comprising an asymmetric ITR pair, or symmetric mod-ITR pair in each of the above classes are provided in Tables 5A and 5B. The predicted secondary structure of the Right modified ITRs in Table 5A are shown in FIG. 7A of International Application PCT/US2018/064242, filed Dec. 6, 2018, and the predicted secondary structure of the Left modified ITRs in Table 5B are shown in FIG. 7B of International Application PCT/US2018/064242, filed Dec. 6, 2018, which is incorporated herein in its entirety by reference.

Table 5A and Table 5B show exemplary right and left modified ITRs.

Table 5A: Exemplary modified right ITRs. These exemplary modified right ITRs can comprise the RBE of GCGCGCTCGCTCGCTC-3' (SEQ ID NO: 60), spacer of ACTGAGGC (SEQ ID NO: 69), the spacer complement GCCTCAGT (SEQ ID NO: 70) and RBE' (i.e., complement to RBE) of GAGCGAGCGAGCGCGC (SEQ ID NO: 71).

TABLE 5A

Exemplary Right modified ITRs

| ITR Construct | Sequence | SEQ ID NO: |
|---|---|---|
| ITR-18 Right | AGGAACCCCTAGTGATGGAGTTGGCCACTCCCTCTCTGCGCGCTCG CTCGCTCACTGAGGCGCACGCCCGGGTTTCCCGGGCGGCCTCAGTG AGCGAGCGAGCGCGCAGCTGCCTGCAGG | 15 |
| ITR-19 Right | AGGAACCCCTAGTGATGGAGTTGGCCACTCCCTCTCTGCGCGCTCG CTCGCTCACTGAGGCCGACGCCCGGGCTTTGCCCGGGCGGCCTCA GTGAGCGAGCGAGCGCGCAGCTGCCTGCAGG | 16 |
| ITR-20 Right | AGGAACCCCTAGTGATGGAGTTGGCCACTCCCTCTCTGCGCGCTCG CTCGCTCACTGAGGCCGGGCGACCAAAGGTCGCCCGACGCCCGGG CGCCTCAGTGAGCGAGCGAGCGCGCAGCTGCCTGCAGG | 17 |
| ITR-21 Right | AGGAACCCCTAGTGATGGAGTTGGCCACTCCCTCTCTGCGCGCTCG CTCGCTCACTGAGGCTTTGCCTCAGTGAGCGAGCGAGCGCGCAGC TGCCTGCAGG | 18 |
| ITR-22 Right | AGGAACCCCTAGTGATGGAGTTGGCCACTCCCTCTCTGCGCGCTCG CTCGCTCACTGAGGCCGGGCGACAAAGTCGCCCGACGCCCGGGCT TTGCCCGGGCGGCCTCAGTGAGCGAGCGAGCGCGCAGCTGCCTGC AGG | 19 |
| ITR-23 Right | AGGAACCCCTAGTGATGGAGTTGGCCACTCCCTCTCTGCGCGCTCG CTCGCTCACTGAGGCCGGGCGAAAATCGCCCGACGCCCGGGCTTT GCCCGGGCGGCCTCAGTGAGCGAGCGAGCGCGCAGCTGCCTGCAG G | 20 |
| ITR-24 Right | AGGAACCCCTAGTGATGGAGTTGGCCACTCCCTCTCTGCGCGCTCG CTCGCTCACTGAGGCCGGGCGAAACGCCCGACGCCCGGGCTTTGC CCGGGCGGCCTCAGTGAGCGAGCGAGCGCGCAGCTGCCTGCAGG | 21 |
| ITR-25 Right | AGGAACCCCTAGTGATGGAGTTGGCCACTCCCTCTCTGCGCGCTCG CTCGCTCACTGAGGCCGGGCAAAGCCCGACGCCCGGGCTTTGCCC GGGCGGCCTCAGTGAGCGAGCGAGCGCGCAGCTGCCTGCAGG | 22 |
| ITR-26 Right | AGGAACCCCTAGTGATGGAGTTGGCCACTCCCTCTCTGCGCGCTCG CTCGCTCACTGAGGCCGGGCGACCAAAGGTCGCCCGACGCCCGGG TTTCCCGGGCGGCCTCAGTGAGCGAGCGAGCGCGCAGCTGCCTGC AGG | 23 |
| ITR-27 Right | AGGAACCCCTAGTGATGGAGTTGGCCACTCCCTCTCTGCGCGCTCG CTCGCTCACTGAGGCCGGGCGACCAAAGGTCGCCCGACGCCCGGT TTCCGGGCGGCCTCAGTGAGCGAGCGAGCGCGCAGCTGCCTGCAG G | 24 |
| ITR-28 Right | AGGAACCCCTAGTGATGGAGTTGGCCACTCCCTCTCTGCGCGCTCG CTCGCTCACTGAGGCCGGGCGACCAAAGGTCGCCCGACGCCCGTT TCGGGCGGCCTCAGTGAGCGAGCGAGCGCGCAGCTGCCTGCAGG | 25 |

TABLE 5A-continued

| Exemplary Right modified ITRs | | |
|---|---|---|
| ITR Construct | Sequence | SEQ ID NO: |
| ITR-29 Right | AGGAACCCCTAGTGATGGAGTTGGCCACTCCCTCTCTGCGCGCTCG CTCGCTCACTGAGGCCGGGCGACCAAAGGTCGCCCGACGCCCTTT GGGCGGCCTCAGTGAGCGAGCGAGCGCGCAGCTGCCTGCAGG | 26 |
| ITR-30 Right | AGGAACCCCTAGTGATGGAGTTGGCCACTCCCTCTCTGCGCGCTCG CTCGCTCACTGAGGCCGGGCGACCAAAGGTCGCCCGACGCCTTTG GCGGCCTCAGTGAGCGAGCGAGCGCGCAGCTGCCTGCAGG | 27 |
| ITR-31 Right | AGGAACCCCTAGTGATGGAGTTGGCCACTCCCTCTCTGCGCGCTCG CTCGCTCACTGAGGCCGGGCGACCAAAGGTCGCCCGACGCTTTGC GGCCTCAGTGAGCGAGCGAGCGCGCAGCTGCCTGCAGG | 28 |
| ITR-32 Right | AGGAACCCCTAGTGATGGAGTTGGCCACTCCCTCTCTGCGCGCTCG CTCGCTCACTGAGGCCGGGCGACCAAAGGTCGCCCGACGTTTCGG CCTCAGTGAGCGAGCGAGCGCGCAGCTGCCTGCAGG | 29 |
| ITR-49 Right | AGGAACCCCTAGTGATGGAGTTGGCCACTCCCTCTCTGCGCGCTCG CTCGCTCACTGAGGCCGGGCGACCAAAGGTCGCCCGACGGCCTCA GTGAGCGAGCGAGCGCGCAGCTGCCTGCAGG | 30 |
| ITR-50 right | AGGAACCCCTAGTGATGGAGTTGGCCACTCCCTCTCTGCGCGCTCG CTCGCTCACTGAGGCCGGGCGACCAAAGGTCGCCCGACGCCCGGG CGGCCTCAGTGAGCGAGCGAGCGCGCAGCTGCCTGCAGG | 31 |

TABLE 5B: Exemplary modified left ITRs. These exemplary modified left ITRs can comprise the RBE of GCGCGCTCGCTCGCTC-3' (SEQ ID NO: 60), spacer of ACTGAGGC (SEQ ID NO: 69), the spacer complement GCCTCAGT (SEQ ID NO: 70) and RBE complement (RBE') of GAGCGAGCGAGCGCGC (SEQ ID NO: 71).

TABLE 5B

| Exemplary modified left ITRs | | |
|---|---|---|
| ITR-33 Left | CCTGCAGGCAGCTGCGCGCTCGCTCGCTCACTGAGGCCGCCCGGG AAACCCGGGCGTGCGCCTCAGTGAGCGAGCGAGCGCGCAGAGAG GGAGTGGCCAACTCCATCACTAGGGGTTCCT | 32 |
| ITR-34 Left | CCTGCAGGCAGCTGCGCGCTCGCTCGCTCACTGAGGCCGTCGGGC GACCTTTGGTCGCCCGGCCTCAGTGAGCGAGCGAGCGCGCAGAGA GGGAGTGGCCAACTCCATCACTAGGGGTTCCT | 33 |
| ITR-35 Left | CCTGCAGGCAGCTGCGCGCTCGCTCGCTCACTGAGGCCGCCCGGG CAAAGCCCGGGCGTCGGCCTCAGTGAGCGAGCGAGCGCGCAGAG AGGGAGTGGCCAACTCCATCACTAGGGGTTCCT | 34 |
| ITR-36 Left | CCTGCAGGCAGCTGCGCGCTCGCTCGCTCACTGAGGCGCCCGGGC GTCGGGCGACCTTTGGTCGCCCGGCCTCAGTGAGCGAGCGAGCGC GCAGAGAGGGAGTGGCCAACTCCATCACTAGGGGTTCCT | 35 |
| ITR-37 Left | CCTGCAGGCAGCTGCGCGCTCGCTCGCTCACTGAGGCAAAGCCTC AGTGAGCGAGCGAGCGCGCAGAGAGGGAGTGGCCAACTCCATCA CTAGGGGTTCCT | 36 |
| ITR-38 Left | CCTGCAGGCAGCTGCGCGCTCGCTCGCTCACTGAGGCCGCCCGGG CAAAGCCCGGGCGTCGGGCGACTTTGTCGCCCGGCCTCAGTGAGC GAGCGAGCGCGCAGAGAGGGAGTGGCCAACTCCATCACTAGGGGT TCCT | 37 |
| ITR-39 Left | CCTGCAGGCAGCTGCGCGCTCGCTCGCTCACTGAGGCCGCCCGGG CAAAGCCCGGGCGTCGGGCGATTTTCGCCCGGCCTCAGTGAGCGA GCGAGCGCGCAGAGAGGGAGTGGCCAACTCCATCACTAGGGGTTC CT | 38 |
| ITR-40 Left | CCTGCAGGCAGCTGCGCGCTCGCTCGCTCACTGAGGCCGCCCGGG CAAAGCCCGGGCGTCGGGCGTTTCGCCCGGCCTCAGTGAGCGAGC GAGCGCGCAGAGAGGGAGTGGCCAACTCCATCACTAGGGGTTCCT | 39 |
| ITR-41 Left | CCTGCAGGCAGCTGCGCGCTCGCTCGCTCACTGAGGCCGCCCGGG CAAAGCCCGGGCGTCGGGCTTTGCCCGGCCTCAGTGAGCGAGCGA GCGCGCAGAGAGGGAGTGGCCAACTCCATCACTAGGGGTTCCT | 40 |
| ITR-42 Left | CCTGCAGGCAGCTGCGCGCTCGCTCGCTCACTGAGGCCGCCCGGG AAACCCGGGCGTCGGGCGACCTTTGGTCGCCCGGCCTCAGTGAGC | 41 |

TABLE 5B-continued

| Exemplary modified left ITRs | | |
|---|---|---|
| | GAGCGAGCGCGCAGAGAGGGAGTGGCCAACTCCATCACTAGGGGT TCCT | |
| ITR-43 Left | CCTGCAGGCAGCTGCGCGCTCGCTCGCTCACTGAGGCCGCCCGGA AACCGGGCGTCGGGCGACCTTTGGTCGCCCGGCCTCAGTGAGCGA GCGAGCGCGCAGAGAGGGAGTGGCCAACTCCATCACTAGGGGTTC CT | 42 |
| ITR-44 Left | CCTGCAGGCAGCTGCGCGCTCGCTCGCTCACTGAGGCCGCCCGAA ACGGGCGTCGGGCGACCTTTGGTCGCCCGGCCTCAGTGAGCGAGC GAGCGCGCAGAGAGGGAGTGGCCAACTCCATCACTAGGGGTTCCT | 43 |
| ITR-45 Left | CCTGCAGGCAGCTGCGCGCTCGCTCGCTCACTGAGGCCGCCCAAA GGGCGTCGGGCGACCTTTGGTCGCCCGGCCTCAGTGAGCGAGCGA GCGCGCAGAGAGGGAGTGGCCAACTCCATCACTAGGGGTTCCT | 44 |
| ITR-46 Left | CCTGCAGGCAGCTGCGCGCTCGCTCGCTCACTGAGGCCGCCAAAG GCGTCGGGCGACCTTTGGTCGCCCGGCCTCAGTGAGCGAGCGAGC GCGCAGAGAGGGAGTGGCCAACTCCATCACTAGGGGTTCCT | 45 |
| ITR-47 Left | CCTGCAGGCAGCTGCGCGCTCGCTCGCTCACTGAGGCCGCAAAGC GTCGGGCGACCTTTGGTCGCCCGGCCTCAGTGAGCGAGCGAGCGC GCAGAGAGGGAGTGGCCAACTCCATCACTAGGGGTTCCT | 46 |
| ITR-48 Left | CCTGCAGGCAGCTGCGCGCTCGCTCGCTCACTGAGGCCGAAACGT CGGGCGACCTTTGGTCGCCCGGCCTCAGTGAGCGAGCGAGCGCGC AGAGAGGGAGTGGCCAACTCCATCACTAGGGGTTCCT | 47 |

In one embodiment, a ceDNA vector for expression of FVIII protein comprises, in the 5' to 3' direction: a first adeno-associated virus (AAV) inverted terminal repeat (ITR), a nucleotide sequence of interest (for example an expression cassette as described herein) and a second AAV ITR, where the first ITR (5' ITR) and the second ITR (3' ITR) are asymmetric with respect to each other—that is, they have a different 3D-spatial configuration from one another. As an exemplary embodiment, the first ITR can be a wild-type ITR and the second ITR can be a mutated or modified ITR, or vice versa, where the first ITR can be a mutated or modified ITR and the second ITR a wild-type ITR. In some embodiment, the first ITR and the second ITR are both mod-ITRs, but have different sequences, or have different modifications, and thus are not the same modified ITRs, and have different 3D spatial configurations. Stated differently, a ceDNA vector with asymmetric ITRs comprises ITRs where any changes in one ITR relative to the WT-ITR are not reflected in the other ITR; or alternatively, where the asymmetric ITRs have a modified asymmetric ITR pair can have a different sequence and different three-dimensional shape with respect to each other. Exemplary asymmetric ITRs in the ceDNA vector for expression of FVIII protein and for use to generate a ceDNA-plasmid are shown in Table 5A and 5B.

In an alternative embodiment, a ceDNA vector for expression of FVIII protein comprises two symmetrical mod-ITRs—that is, both ITRs have the same sequence, but are reverse complements (inverted) of each other. In some embodiments, a symmetrical mod-ITR pair comprises at least one or any combination of a deletion, insertion, or substitution relative to wild type ITR sequence from the same AAV serotype. The additions, deletions, or substitutions in the symmetrical ITR are the same but the reverse complement of each other. For example, an insertion of 3 nucleotides in the C region of the 5' ITR would be reflected in the insertion of 3 reverse complement nucleotides in the corresponding section in the C' region of the 3' ITR. Solely for illustration purposes only, if the addition is AACG in the 5' ITR, the addition is CGTT in the 3' ITR at the corresponding site. For example, if the 5' ITR sense strand is ATCGATCG with an addition of AACG between the G and A to result in the sequence ATCGAACGATCG (SEQ ID NO: 51). The corresponding 3' ITR sense strand is CGATCGAT (the reverse complement of ATCGATCG) with an addition of CGTT (i.e. the reverse complement of AACG) between the T and C to result in the sequence CGATCGTTCGAT (SEQ ID NO: 49) (the reverse complement of ATCGAACGATCG) (SEQ ID NO: 51).

In alternative embodiments, the modified ITR pair are substantially symmetrical as defined herein—that is, the modified ITR pair can have a different sequence but have corresponding or the same symmetrical three-dimensional shape. For example, one modified ITR can be from one serotype and the other modified ITR be from a different serotype, but they have the same mutation (e.g., nucleotide insertion, deletion or substitution) in the same region. Stated differently, for illustrative purposes only, a 5' mod-ITR can be from AAV2 and have a deletion in the C region, and the 3' mod-ITR can be from AAV5 and have the corresponding deletion in the C' region, and provided the 5' mod-ITR and the 3' mod-ITR have the same or symmetrical three-dimensional spatial organization, they are encompassed for use herein as a modified ITR pair.

In some embodiments, a substantially symmetrical mod-ITR pair has the same A, C-C' and B-B' loops in 3D space, e.g., if a modified ITR in a substantially symmetrical mod-ITR pair has a deletion of a C-C' arm, then the cognate mod-ITR has the corresponding deletion of the C-C' loop and also has a similar 3D structure of the remaining A and B-B' loops in the same shape in geometric space of its cognate mod-ITR. By way of example only, substantially symmetrical ITRs can have a symmetrical spatial organization such that their structure is the same shape in geometrical space. This can occur, e.g., when a G-C pair is modified, for example, to a C-G pair or vice versa, or A-T pair is modified to a T-A pair, or vice versa. Therefore, using the exemplary example above of modified 5' ITR as a ATCGAACGATCG (SEQ ID NO: 51), and modified 3' ITR as CGATCGTTCGAT (SEQ ID NO: 49) (i.e., the reverse complement of ATCGAACGATCG (SEQ ID NO: 51)), these modified ITRs would still be symmetrical if, for example, the 5' ITR had the sequence of ATCGAACCATCG (SEQ ID NO: 50), where G in the addition is modified to C, and the substantially symmetrical 3' ITR has the sequence of CGATCGTTCGAT (SEQ ID NO: 49), without the corresponding modification of the T in the addition to a. In some embodiments, such a modified ITR pair are substantially symmetrical as the modified ITR pair has symmetrical stereochemistry.

Table 6 shows exemplary symmetric modified ITR pairs (i.e. a left modified ITRs and the symmetric right modified ITR) for use in a ceDNA vector for expression of FVIII protein. The bold (red) portion of the sequences identify partial ITR sequences (i.e., sequences of A-A', C-C' and B-B' loops), also shown in FIGS. 31A-46B. These exemplary modified ITRs can comprise the RBE of GCGCGCTCGCTCGCTC-3' (SEQ ID NO: 60), spacer of ACTGAGGC (SEQ ID NO: 69), the spacer complement GCCTCAGT (SEQ ID NO: 70) and RBE' (i.e., complement to RBE) of GAGCGAGCGAGCGCGC (SEQ ID NO: 71).

TABLE 6

Exemplary symmetric modified ITR pairs in a ceDNA vector for expression of FVIII protein

| LEFT modified ITR (modified 5' ITR) | | Symmetric RIGHT modified ITR (modified 3' ITR) | |
|---|---|---|---|
| SEQ ID NO: 32 (ITR-33 left) | CCTGCAGGCAGCT**GCGCGCTC**<br>**GCTCGCTCACTGAGGCCGCC**<br>**CGGGAAACCCGGGCGTGCGC**<br>**CTCAGTGAGCGAGCGAGCGC**<br>**GC**AGAGAGGGAGTGGCCAACT<br>CCATCACTAGGGGTTCCT | SEQ ID NO: 15 (ITR-18, right) | AGGAACCCCTAGTGATG<br>GAGTTGGCCACTCCCTCT<br>CT**GCGCGCTCGCTCGC**<br>**TCACTGAGGCGCACGC**<br>**CCGGGTTTCCCGGGCG**<br>**GCCTCAGTGAGCGAGC**<br>**GAGCGCGC**AGCTGCCT<br>GCAGG |
| SEQ ID NO: 33 (ITR-34 left) | CCTGCAGGCAGCT**GCGCGCTC**<br>**GCTCGCTCACTGAGGCCGTC**<br>**GGGCGACCTTTGGTCGCCCG**<br>**GCCTCAGTGAGCGAGCGAGC**<br>**GCGC**AGAGAGGGAGTGGCCA<br>ACTCCATCACTAGGGGTTCCT | SEQ ID NO: 48 (ITR-51, right) | AGGAACCCCTAGTGATG<br>GAGTTGGCCACTCCCTCT<br>CT**GCGCGCTCGCTCGC**<br>**TCACTGAGGCCGGGCG**<br>**ACCAAAGGTCGCCCGA**<br>**CGGCCTCAGTGAGCGA**<br>**GCGAGCGCGC**AGCTGC<br>CTGCAGG |
| SEQ ID NO: 34 (ITR-35 left) | CCTGCAGGCAGCT**GCGCGCTC**<br>**GCTCGCTCACTGAGGCCGCC**<br>**CGGGCAAAGCCCGGGCGTCG**<br>**GCCTCAGTGAGCGAGCGAGC**<br>**GCGC**AGAGAGGGAGTGGCCA<br>ACTCCATCACTAGGGGTTCCT | SEQ ID NO: 16 (ITR-19, right) | AGGAACCCCTAGTGATG<br>GAGTTGGCCACTCCCTCT<br>CT**GCGCGCTCGCTCGC**<br>**TCACTGAGGCCGACGC**<br>**CCGGGCTTTGCCCGGG**<br>**CGGCCTCAGTGAGCGA**<br>**GCGAGCGCGC**AGCTGC<br>CTGCAGG |
| SEQ ID NO: 35 (ITR-36 left) | CCTGCAGGCAGCT**GCGCGCTC**<br>**GCTCGCTCACTGAGGCGCCC**<br>**GGGCGTCGGGCGACCTTTGG**<br>**TCGCCCGGCCTCAGTGAGCG**<br>**AGCGAGCGCGC**AGAGAGGGA<br>GTGGCCAACTCCATCACTAGG<br>GGTTCCT | SEQ ID NO: 17 (ITR-20, right) | AGGAACCCCTAGTGATG<br>GAGTTGGCCACTCCCTCT<br>CT**GCGCGCTCGCTCGC**<br>**TCACTGAGGCCGGGCG**<br>**ACCAAAGGTCGCCCGA**<br>**CGCCCGGGCGCCTCAG**<br>**TGAGCGAGCGAGCGCG**<br>**C**AGCTGCCTGCAGG |
| SEQ ID NO: 36 (ITR-37 left) | CCTGCAGGCAGCT**GCGCGCTC**<br>**GCTCGCTCACTGAGGCAAAG**<br>**CCTCAGTGAGCGAGCGAGCG**<br>**CGC**AGAGAGGGAGTGGCCAAC<br>TCCATCACTAGGGGTTCCT | SEQ ID NO: 18 (ITR-21, right) | AGGAACCCCTAGTGATG<br>GAGTTGGCCACTCCCTCT<br>CT**GCGCGCTCGCTCGC**<br>**TCACTGAGGCTTTGCC**<br>**TCAGTGAGCGAGCGAG**<br>**CGCGC**AGCTGCCTGCAG<br>G |
| SEQ ID NO: 37 (ITR-38 left) | CCTGCAGGCAGCT**GCGCGCTC**<br>**GCTCGCTCACTGAGGCCGCC**<br>**CGGGCAAAGCCCGGGCGTCG**<br>**GGCGACTTTGTCGCCCGGCC**<br>**TCAGTGAGCGAGCGAGCGCG**<br>**C**AGAGAGGGAGTGGCCAACTC<br>CATCACTAGGGGTTCCT | SEQ ID NO: 19 (ITR-22 right) | AGGAACCCCTAGTGATG<br>GAGTTGGCCACTCCCTCT<br>CT**GCGCGCTCGCTCGC**<br>**TCACTGAGGCCGGGCG**<br>**ACAAAGTCGCCCGACG**<br>**CCCGGGCTTTGCCCGG**<br>**GCGGCCTCAGTGAGCG**<br>**AGCGAGCGCGC**AGCTG<br>CCTGCAGG |
| SEQ ID NO: 38 (ITR-39 left) | CCTGCAGGCAGCT**GCGCGCTC**<br>**GCTCGCTCACTGAGGCCGCC**<br>**CGGGCAAAGCCCGGGCGTCG**<br>**GGCGATTTTCGCCCGGCCTC**<br>**AGTGAGCGAGCGAGCGCGC**A | SEQ ID NO: 20 (ITR-23, right) | AGGAACCCCTAGTGATG<br>GAGTTGGCCACTCCCTCT<br>CT**GCGCGCTCGCTCGC**<br>**TCACTGAGGCCGGGCG**<br>**AAAATCGCCCGACGCC** |

TABLE 6-continued

Exemplary symmetric modified ITR pairs in a ceDNA vector for expression of FVIII protein

| | LEFT modified ITR (modified 5' ITR) | | Symmetric RIGHT modified ITR (modified 3' ITR) |
|---|---|---|---|
| | GAGAGGGAGTGGCCAACTCCA<br>TCACTAGGGGTTCCT | | **CGGGCTTTGCCCGGGC**<br>**GGCCTCAGTGAGCGAG**<br>**CGAGCGCGC**AGCTGCC<br>TGCAGG |
| SEQ ID NO: 39 (ITR-40 left) | CCTGCAGGCAGCT**GCGCGCTC**<br>**GCTCGCTCACTGAGGCCGCC**<br>**CGGGCAAAGCCCGGGCGTCG**<br>**GGCGTTTCGCCCGGCCTCAG**<br>**TGAGCGAGCGAGCGCGC**AGA<br>GAGGGAGTGGCCAACTCCATC<br>ACTAGGGGTTCCT | SEQ ID NO: 21 (ITR-24, right) | AGGAACCCCTAGTGATG<br>GAGTTGGCCACTCCCTCT<br>CT**GCGCGCTCGCTCGC**<br>**TCACTGAGGCCGGGCG**<br>**AAACGCCCGACGCCCG**<br>**GGCTTTGCCCGGGCGG**<br>**CCTCAGTGAGCGAGCG**<br>**AGCGCGC**AGCTGCCTGC<br>AGG |
| SEQ ID NO: 40 (ITR-41 left) | CCTGCAGGCAGCT**GCGCGCTC**<br>**GCTCGCTCACTGAGGCCGCC**<br>**CGGGCAAAGCCCGGGCGTCG**<br>**GGCTTTGCCCGGCCTCAGTG**<br>**AGCGAGCGAGCGCGC**AGAGA<br>GGGAGTGGCCAACTCCATCAC<br>TAGGGGTTCCT | SEQ ID NO: 22 (ITR-25 right) | AGGAACCCCTAGTGATG<br>GAGTTGGCCACTCCCTCT<br>CT**GCGCGCTCGCTCGC**<br>**TCACTGAGGCCGGGCA**<br>**AAGCCCGACGCCCGGG**<br>**CTTTGCCCGGGCGGCC**<br>**TCAGTGAGCGAGCGAG**<br>**CGCGC**AGCTGCCTGCAG<br>G |
| SEQ ID NO: 41 (ITR-42 left) | CCTGCAGGCAGCT**GCGCGCTC**<br>**GCTCGCTCACTGAGGCCGCC**<br>**CGGGAAACCCGGGCGTCGGG**<br>**CGACCTTTGGTCGCCCGGCC**<br>**TCAGTGAGCGAGCGAGCGCG**<br>**C**AGAGAGGGAGTGGCCAACTC<br>CATCACTAGGGGTTCCT | SEQ ID NO: 23 (ITR-26 right) | AGGAACCCCTAGTGATG<br>GAGTTGGCCACTCCCTCT<br>CT**GCGCGCTCGCTCGC**<br>**TCACTGAGGCCGGGCG**<br>**ACCAAAGGTCGCCCGA**<br>**CGCCCGGGTTTCCCGG**<br>**GCGGCCTCAGTGAGCG**<br>**AGCGAGCGCGC**AGCTG<br>CCTGCAGG |
| SEQ ID NO: 42 (ITR-43 left) | CCTGCAGGCAGCT**GCGCGCTC**<br>**GCTCGCTCACTGAGGCCGCC**<br>**CGGAAACCGGGCGTCGGGCG**<br>**ACCTTTGGTCGCCCGGCCTC**<br>**AGTGAGCGAGCGAGCGCGC**A<br>GAGAGGGAGTGGCCAACTCCA<br>TCACTAGGGGTTCCT | SEQ ID NO: 24 (ITR-27 right) | AGGAACCCCTAGTGATG<br>GAGTTGGCCACTCCCTCT<br>CT**GCGCGCTCGCTCGC**<br>**TCACTGAGGCCGGGCG**<br>**ACCAAAGGTCGCCCGA**<br>**CGCCCGGTTTCCGGGC**<br>**GGCCTCAGTGAGCGAG**<br>**CGAGCGCGC**AGCTGCC<br>TGCAGG |
| SEQ ID NO: 43 (ITR-44 left) | CCTGCAGGCAGCT**GCGCGCTC**<br>**GCTCGCTCACTGAGGCCGCC**<br>**CGAAACGGGCGTCGGGCGAC**<br>**CTTTGGTCGCCCGGCCTCAG**<br>**TGAGCGAGCGAGCGCGC**AGA<br>GAGGGAGTGGCCAACTCCATC<br>ACTAGGGGTTCCT | SEQ ID NO: 25 (ITR-28 right) | AGGAACCCCTAGTGATG<br>GAGTTGGCCACTCCCTCT<br>CT**GCGCGCTCGCTCGC**<br>**TCACTGAGGCCGGGCG**<br>**ACCAAAGGTCGCCCGA**<br>**CGCCCGTTTCGGGCGG**<br>**CCTCAGTGAGCGAGCG**<br>**AGCGCGC**AGCTGCCTGC<br>AGG |
| SEQ ID NO: 44 (ITR-45 left) | CCTGCAGGCAGCT**GCGCGCTC**<br>**GCTCGCTCACTGAGGCCGCC**<br>**CAAAGGGCGTCGGGCGACCT**<br>**TTGGTCGCCCGGCCTCAGTG**<br>**AGCGAGCGAGCGCGC**AGAGA<br>GGGAGTGGCCAACTCCATCAC<br>TAGGGGTTCCT | SEQ ID NO: 26 (ITR-29, right) | AGGAACCCCTAGTGATG<br>GAGTTGGCCACTCCCTCT<br>CT**GCGCGCTCGCTCGC**<br>**TCACTGAGGCCGGGCG**<br>**ACCAAAGGTCGCCCGA**<br>**CGCCCTTTGGGCGGCC**<br>**TCAGTGAGCGAGCGAG**<br>**CGCGC**AGCTGCCTGCAG<br>G |
| SEQ ID NO: 45 (ITR-46 left) | CCTGCAGGCAGCT**GCGCGCTC**<br>**GCTCGCTCACTGAGGCCGCC**<br>**AAAGGCGTCGGGCGACCTTT**<br>**GGTCGCCCGGCCTCAGTGAG**<br>**CGAGCGAGCGCGC**AGAGAGG<br>GAGTGGCCAACTCCATCACTA<br>GGGGTTCCT | SEQ ID NO: 27(ITR-30, right) | AGGAACCCCTAGTGATG<br>GAGTTGGCCACTCCCTCT<br>CT**GCGCGCTCGCTCGC**<br>**TCACTGAGGCCGGGCG**<br>**ACCAAAGGTCGCCCGA**<br>**CGCCTTTGGCGGCCTC**<br>**AGTGAGCGAGCGAGCG**<br>**CGC**AGCTGCCTGCAGG |

TABLE 6-continued

Exemplary symmetric modified ITR pairs in a ceDNA vector for expression of FVIII protein

| LEFT modified ITR (modified 5' ITR) | | Symmetric RIGHT modified ITR (modified 3' ITR) | |
|---|---|---|---|
| SEQ ID NO: 46 (ITR-47, left) | CCTGCAGGCAGCTGCGCGCTC<br>GCTCGCTCACTGAGGCCGCA<br>AAGCGTCGGGCGACCTTTGG<br>TCGCCCGGCCTCAGTGAGCG<br>AGCGAGCGCGCAGAGAGGGA<br>GTGGCCAACTCCATCACTAGG<br>GGTTCCT | SEQ ID NO: 28 (ITR-31, right) | AGGAACCCCTAGTGATG<br>GAGTTGGCCACTCCCTCT<br>CTGCGCGCTCGCTCGC<br>TCACTGAGGCCGGGCG<br>ACCAAAGGTCGCCCGA<br>CGCTTTGCGGCCTCAG<br>TGAGCGAGCGAGCGCG<br>CAGCTGCCTGCAGG |
| SEQ ID NO: 47 (ITR-48, left) | CCTGCAGGCAGCTGCGCGCTC<br>GCTCGCTCACTGAGGCCGAA<br>ACGTCGGGCGACCTTTGGTC<br>GCCCGGCCTCAGTGAGCGAG<br>CGAGCGCGCAGAGAGGGAGT<br>GGCCAACTCCATCACTAGGGG<br>TTCCT | SEQ ID NO: 29 (ITR-32 right) | AGGAACCCCTAGTGATG<br>GAGTTGGCCACTCCCTCT<br>CTGCGCGCTCGCTCGC<br>TCACTGAGGCCGGGCG<br>ACCAAAGGTCGCCCGA<br>CGTTTCGGCCTCAGTG<br>AGCGAGCGAGCGCGCA<br>GCTGCCTGCAGG |

In some embodiments, a ceDNA vector for expression of FVIII protein comprising an asymmetric ITR pair can comprise an ITR with a modification corresponding to any of the modifications in ITR sequences or ITR partial sequences shown in any one or more of Tables 5A-5B herein, or the sequences shown in FIG. 7A-7B of International Application PCT/US2018/064242, filed Dec. 6, 2018, which is incorporated herein in its entirety, or disclosed in Tables 2, 3, 4, 5, 6, 7, 8, 9 or 10A-10B of International application PCT/US18/49996 filed Sep. 7, 2018 which is incorporated herein in its entirety by reference.

V. Exemplary ceDNA Vectors

As described above, the present disclosure relates to recombinant ceDNA expression vectors and ceDNA vectors that encode FVIII protein, comprising any one of: an asymmetrical ITR pair, a symmetrical ITR pair, or substantially symmetrical ITR pair as described above. In certain embodiments, the disclosure relates to recombinant ceDNA vectors for expression of FVIII protein having flanking ITR sequences and a transgene, where the ITR sequences are asymmetrical, symmetrical or substantially symmetrical relative to each other as defined herein, and the ceDNA further comprises a nucleotide sequence of interest (for example an expression cassette comprising the nucleic acid of a transgene) located between the flanking ITRs, wherein said nucleic acid molecule is devoid of viral capsid protein coding sequences.

The ceDNA expression vector for expression of FVIII protein may be any ceDNA vector that can be conveniently subjected to recombinant DNA procedures including nucleotide sequence(s) as described herein, provided at least one ITR is altered. The ceDNA vectors for expression of FVIII protein of the present disclosure are compatible with the host cell into which the ceDNA vector is to be introduced. In certain embodiments, the ceDNA vectors may be linear. In certain embodiments, the ceDNA vectors may exist as an extrachromosomal entity. In certain embodiments, the ceDNA vectors of the present disclosure may contain an element(s) that permits integration of a donor sequence into the host cell's genome. As used herein "transgene" and "heterologous nucleotide sequence" are synonymous, and encode FVIII protein, as described herein.

Referring now to FIGS. 1A-1G, schematics of the functional components of two non-limiting plasmids useful in making a ceDNA vector for expression of FVIII protein are shown. FIG. 1A, 1B, 1D, 1F show the construct of ceDNA vectors or the corresponding sequences of ceDNA plasmids for expression of FVIII protein. ceDNA vectors are capsid-free and can be obtained from a plasmid encoding in this order: a first ITR, an expressible transgene cassette and a second ITR, where the first and second ITR sequences are asymmetrical, symmetrical or substantially symmetrical relative to each other as defined herein. ceDNA vectors for expression of FVIII protein are capsid-free and can be obtained from a plasmid encoding in this order: a first ITR, an expressible transgene (protein or nucleic acid) and a second ITR, where the first and second ITR sequences are asymmetrical, symmetrical or substantially symmetrical relative to each other as defined herein. In some embodiments, the expressible transgene cassette includes, as needed: an enhancer/promoter, one or more homology arms, a donor sequence, a post-transcription regulatory element (e.g., WPRE, e.g., SEQ ID NO: 67)), and a polyadenylation and termination signal (e.g., BGH polyA, e.g., SEQ ID NO: 68).

Figure 5:
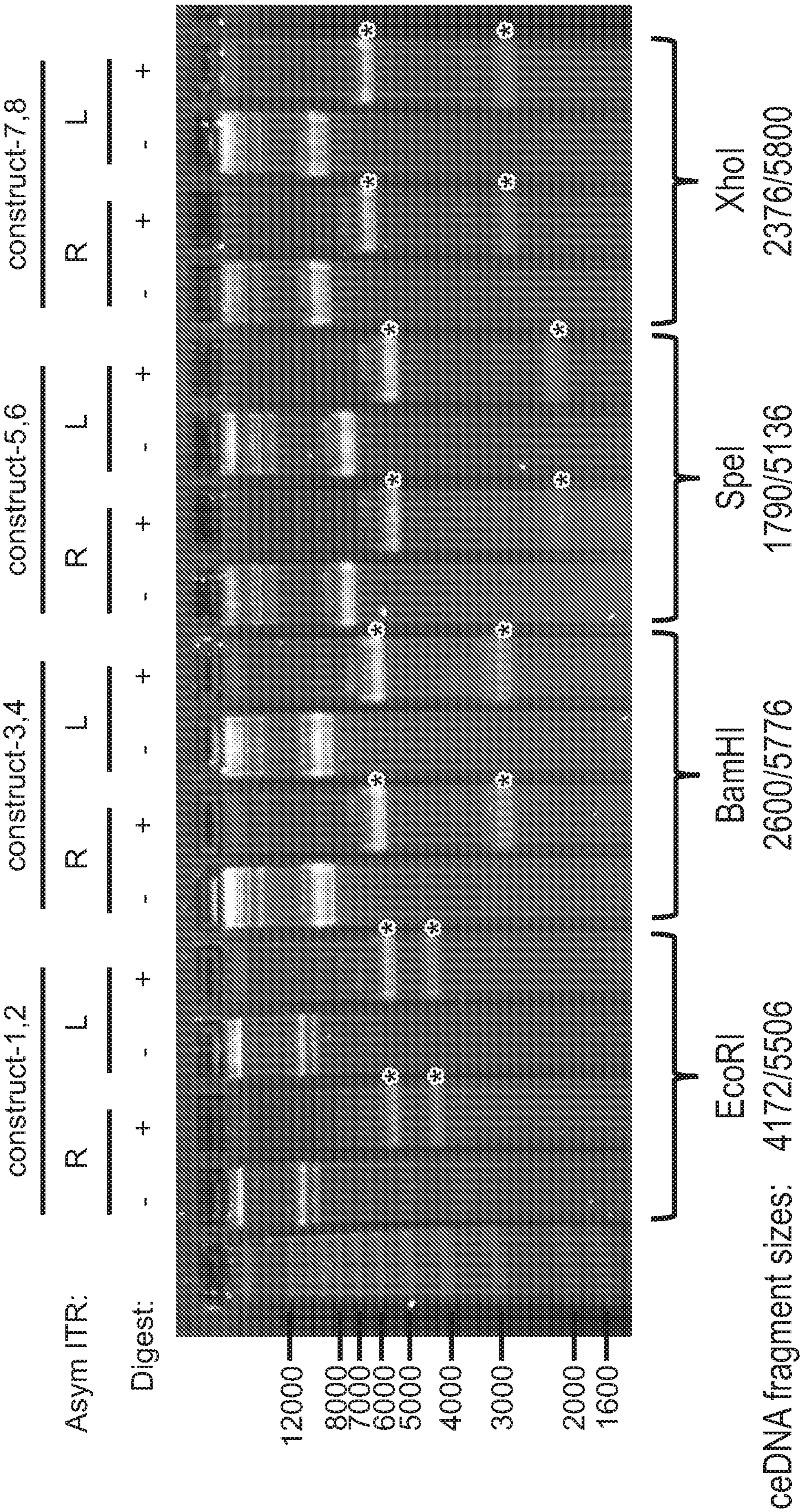
FIG. 5 is an exemplary picture of a denaturing gel running examples of ceDNA vectors with (+) or without (−) digestion with endonucleases (EcoRI for ceDNA construct 1 and 2; BamH1 for ceDNA construct 3 and 4; SpeI for ceDNA construct 5 and 6; and XhoI for ceDNA construct 7 and 8) Constructs 1-8 are described in Example 1 of International Application PCT PCT/US18/49996, which is incorporated herein in its entirety by reference. Sizes of bands highlighted with an asterisk were determined and provided on the bottom of the picture.

FIG. 5 is a gel confirming the production of ceDNA from multiple plasmid constructs using the method described in the Examples. The ceDNA is confirmed by a characteristic band pattern in the gel, as discussed with respect to FIG. 4A above and in the Examples.

A. Regulatory Elements

The ceDNA vectors for expression of FVIII protein as described herein comprising an asymmetric ITR pair or symmetric ITR pair as defined herein, can further comprise a specific combination of cis-regulatory elements. The cis-regulatory elements include, but are not limited to, a promoter, a riboswitch, an insulator, a mir-regulatable element, a post-transcriptional regulatory element, a tissue- and cell type-specific promoter and an enhancer. In some embodiments, the ITR can act as the promoter for the transgene, e.g., FVIII protein. In some embodiments, the ceDNA vector for expression of FVIII protein as described herein comprises additional components to regulate expression of the transgene, for example, regulatory switches as described herein, to regulate the expression of the transgene, or a kill switch, which can kill a cell comprising the ceDNA vector encoding FVIII protein thereof. Regulatory elements, including Regulatory Switches that can be used in the present invention are more fully discussed in International application PCT/US18/49996, which is incorporated herein in its entirety by reference.

In embodiments, the second nucleotide sequence includes a regulatory sequence, and a nucleotide sequence encoding a nuclease. In certain embodiments the gene regulatory sequence is operably linked to the nucleotide sequence encoding the nuclease. In certain embodiments, the regulatory sequence is suitable for controlling the expression of the nuclease in a host cell. In certain embodiments, the regulatory sequence includes a suitable promoter sequence, being able to direct transcription of a gene operably linked to the promoter sequence, such as a nucleotide sequence encoding the nuclease(s) of the present disclosure. In certain embodiments, the second nucleotide sequence includes an intron sequence linked to the 5' terminus of the nucleotide sequence encoding the nuclease. In certain embodiments, an enhancer sequence is provided upstream of the promoter to increase the efficacy of the promoter. In certain embodiments, the regulatory sequence includes an enhancer and a promoter, wherein the second nucleotide sequence includes an intron sequence upstream of the nucleotide sequence encoding a nuclease, wherein the intron includes one or more nuclease cleavage site(s), and wherein the promoter is operably linked to the nucleotide sequence encoding the nuclease.

The ceDNA vectors for expression of FVIII protein produced synthetically, or using a cell-based production method as described herein in the Examples, can further comprise a specific combination of cis-regulatory elements such as WHP posttranscriptional regulatory element (WPRE) (e.g., SEQ ID NO: 67) and BGH polyA (SEQ ID NO: 68). Suitable expression cassettes for use in expression constructs are not limited by the packaging constraint imposed by the viral capsid.

(i) Promoters:

It will be appreciated by one of ordinary skill in the art that promoters used in the ceDNA vectors for expression of FVIII protein as disclosed herein should be tailored as appropriate for the specific sequences they are promoting. According to some embodiments, the promoter is any promoter or promoter sequence set forth in International Application No. PCT/US2020/021328, filed on Mar. 6, 2020, incorporated by reference in its entirety herein.

According to some embodiments, the promoter is VandenDriessche (VD) promoter. According to some embodiments, the VD promoter comprises SEQ ID NO: 191 shown below:

```
                                      (SEQ ID NO: 191)
CGGGGGAGGCTGCTGGTGAATATTAACCAAGGTCACCCCAGTTATCGGAGG

AGCAAACAGGGGCTAAGTCCACACGCGTGGTACCGTCTGTCTGCACATTTC

GTAGAGCGAGTGTTCCGATACTCTAATCTCCCTAGGCAAGGTTCATATTTG

TGTAGGTTACTTATTCTCCTTTTGTTGACTAAGTCAATAATCAGAATCAGC

AGGTTTGGAGTCAGCTTGGCAGGGATCAGCAGCCTGGGTTGGAAGGAGGGG

GTATAAAAGCCCCTTCACCAGGAGAAGCCGTCACACAGATCCACAAGCTCC

TGAAGAGGTAAGGGTTTAAGGGATGGTTGGTTGGTGGGGTATTAATGTTTA

ATTACCTGGAGCACCTGCCTGAAATCACTTTTTTTCAGGTTG.
```

According to some embodiments, the promoter comprises a nucleic acid sequence at least about 85% identical to SEQ ID NO: 191. According to some embodiments, the promoter comprises a nucleic acid sequence at least about 90% identical to SEQ ID NO: 191. According to some embodiments, the promoter comprises a nucleic acid sequence at least about 95% identical to SEQ ID NO: 191. According to some embodiments, the promoter comprises a nucleic acid sequence at least about 96% identical to SEQ ID NO: 191. According to some embodiments, the promoter comprises a nucleic acid sequence at least about 97% identical to SEQ ID NO: 191. According to some embodiments, the promoter comprises a nucleic acid sequence at least about 98% identical to SEQ ID NO: 191. According to some embodiments, the promoter comprises a nucleic acid sequence at least about 99% identical to SEQ ID NO: 191. According to some embodiments, the promoter consists of the nucleic acid sequence of SEQ ID NO: 191.

Expression cassettes of the ceDNA vector for expression of FVIII protein can include a promoter, which can influence overall expression levels as well as cell-specificity. For transgene expression, e.g., expression of FVIII protein, they can include a highly active virus-derived immediate early promoter. Expression cassettes can contain tissue-specific eukaryotic promoters to limit transgene expression to specific cell types and reduce toxic effects and immune responses resulting from unregulated, ectopic expression. In some embodiments, an expression cassette can contain a promoter or synthetic regulatory element, such as a CAG promoter (SEQ ID NO: 72). The CAG promoter comprises (i) the cytomegalovirus (CMV) early enhancer element, (ii) the promoter, the first exon and the first intron of chicken beta-actin gene, and (iii) the splice acceptor of the rabbit beta-globin gene. Alternatively, an expression cassette can contain an Alpha-1-antitrypsin (AAT) promoter (SEQ ID NO: 73 or SEQ ID NO: 74), a liver specific (LP1) promoter (SEQ ID NO: 75 or SEQ ID NO: 76), or a Human elongation factor-1 alpha (EF1a) promoter (e.g., SEQ ID NO: 77 or SEQ ID NO: 78). In some embodiments, the expression cassette includes one or more constitutive promoters, for example, a retroviral Rous sarcoma virus (RSV) LTR promoter (optionally with the RSV enhancer), or a cytomegalovirus (CMV) immediate early promoter (optionally with the CMV enhancer, e.g., SEQ ID NO: 79). Alternatively, an inducible promoter, a native promoter for a transgene, a tissue-specific promoter, or various promoters known in the art can be used.

Suitable promoters, including those described herein, can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6, e.g., SEQ ID NO: 80) (Miyagishi et al., *Nature Biotechnology* 20, 497-500 (2002)), an enhanced U6 promoter (e.g., Xia et al., *Nucleic Acids Res.* 2003 Sep. 1; 31(17)), a human H1 promoter (H1) (e.g., SEQ ID NO: 81 or SEQ ID NO: 155), a CAG promoter, a human alpha 1-antitypsin (HAAT) promoter (e.g., SEQ ID NO: 82), and the like. In certain embodiments, these promoters are altered at their downstream intron containing end to include one or more nuclease cleavage sites. In certain embodiments, the DNA containing the nuclease cleavage site(s) is foreign to the promoter DNA.

In one embodiment, the promoter used is the native promoter of the gene encoding the therapeutic protein. The promoters and other regulatory sequences for the respective genes encoding the therapeutic proteins are known and have been characterized. The promoter region used may further include one or more additional regulatory sequences (e.g., native), e.g., enhancers, (e.g. SEQ ID NO: 79 and SEQ ID NO: 83), including a SV40 enhancer (SEQ ID NO: 126).

In some embodiments, a promoter may also be a promoter from a human gene such as human ubiquitin C (hUbC), human actin, human myosin, human hemoglobin, human muscle creatine, or human metallothionein. The promoter may also be a tissue specific promoter, such as a liver specific promoter, such as human alpha 1-antitypsin (HAAT), natural or synthetic. In one embodiment, delivery to the liver can be achieved using endogenous ApoE specific targeting of the composition comprising a ceDNA vector to hepatocytes via the low-density lipoprotein (LDL) receptor present on the surface of the hepatocyte.

Non-limiting examples of suitable promoters for use in accordance with the present invention include any of the promoters described herein, or any of the following: the CAG promoter of, for example (SEQ ID NO: 72), the HAAT promoter (SEQ ID NO: 82), the human EF1-α promoter (SEQ ID NO: 77) or a fragment of the EF1a promoter (SEQ ID NO: 78), 1E2 promoter (e.g., SEQ ID NO: 84) and the rat EF1-α promoter (SEQ ID NO: 85), mEF1 promoter (SEQ ID NO: 59), or 1E1 promoter fragment (SEQ ID NO: 125).

(ii) Enhancers

In some embodiments, a ceDNA expressing FVIII comprises one or more enhancers. In some embodiments, an enhancer sequence is located 5' of the promoter sequence. In some embodiments, the enhancer sequence is located 3' of the promoter sequence. According to some embodiments, the enhancer is any enhancer or enhancer sequence set forth in International Application No. PCT/US2020/021328, filed on Mar. 6, 2020, incorporated by reference in its entirety herein.

(iii) 5' UTR Sequences and Intron Sequences

In some embodiments, a ceDNA vector comprises a 5' UTR sequence and/or an intron sequence that located 3' of the 5' ITR sequence. In some embodiments, the 5' UTR is located 5' of the transgene, e.g., sequence encoding the FVIII protein. Exemplary 5' UTR sequences listed in International Application No. PCT/US2020/021328, for example in Table 9A, incorporated by reference in its entirety herein.

(iv) 3' UTR Sequences

In some embodiments, a ceDNA vector comprises a 3' UTR sequence that located 5' of the 3' ITR sequence. In some embodiments, the 3' UTR is located 3' of the transgene, e.g., sequence encoding the FVIII protein. Exemplary 3' UTR sequences listed in International Application No. PCT/US2020/021328, for example in Table 9B, incorporated by reference in its entirety herein. (v)

Polyadenylation Sequences:

A sequence encoding a polyadenylation sequence can be included in the ceDNA vector for expression of FVIII protein to stabilize an mRNA expressed from the ceDNA vector, and to aid in nuclear export and translation. In one embodiment, the ceDNA vector does not include a polyadenylation sequence. In other embodiments, the ceDNA vector for expression of FVIII protein includes at least 1, at least 2, at least 3, at least 4, at least 5, at least 10, at least 15, at least 20, at least 25, at least 30, at least 40, least 45, at least 50 or more adenine dinucleotides. In some embodiments, the polyadenylation sequence comprises about 43 nucleotides, about 40-50 nucleotides, about 40-55 nucleotides, about 45-50 nucleotides, about 35-50 nucleotides, or any range there between.

The expression cassettes can include any poly-adenylation sequence known in the art or a variation thereof. In some embodiments, a poly-adenylation (polyA) sequence is selected from any of those listed in International Application No. PCT/US2020/021328, for example in Table 10, incorporated by reference in its entirety herein. Other polyA sequences commonly known in the art can also be used, e.g., including but not limited to, naturally occurring sequence isolated from bovine BGHpA (e.g., SEQ ID NO: 68) or a virus SV40pA (e.g., SEQ ID NO: 86), or a synthetic sequence (e.g., SEQ ID NO: 87). Some expression cassettes can also include SV40 late polyA signal upstream enhancer (USE) sequence. In some embodiments, a USE sequence can be used in combination with SV40pA or heterologous poly-A signal. PolyA sequences are located 3' of the transgene encoding the FVIII protein.

The expression cassettes can also include a post-transcriptional element to increase the expression of a transgene. In some embodiments, Woodchuck Hepatitis Virus (WHP) posttranscriptional regulatory element (WPRE) (e.g., SEQ ID NO: 67) is used to increase the expression of a transgene. Other posttranscriptional processing elements such as the post-transcriptional element from the thymidine kinase gene of herpes simplex virus, or hepatitis B virus (HBV) can be used. Secretory sequences can be linked to the transgenes, e.g., VH-02 and VK-A26 sequences, e.g., SEQ ID NO: 88 and SEQ ID NO: 89.

(vi) Nuclear Localization Sequences

In some embodiments, the ceDNA vector for expression of FVIII protein comprises one or more nuclear localization sequences (NLSs), for example, 1, 2, 3, 4, 5, 6, 7, 8, 9, 10, or more NLSs. In some embodiments, the one or more NLSs are located at or near the amino-terminus, at or near the carboxy-terminus, or a combination of these (e.g., one or more NLS at the amino-terminus and/or one or more NLS at the carboxy terminus). When more than one NLS is present, each can be selected independently of the others, such that a single NLS is present in more than one copy and/or in combination with one or more other NLSs present in one or more copies. Non-limiting examples of NLSs are shown in Table 7.

TABLE 7

Nuclear Localization Signals

| SOURCE | SEQUENCE | SEQ ID NO. |
|---|---|---|
| SV40 virus large T-antigen | PKKKRKV (encoded by CCCAAGAAGAAGAGGAAGGTG; SEQ ID NO: 91) | 90 |

TABLE 7-continued

Nuclear Localization Signals

| SOURCE | SEQUENCE | SEQ ID NO. |
|---|---|---|
| nucleoplasmin | KRPAATKKAGQAKKKK | 92 |
| c-myc | PAAKRVKLD | 93 |
| | RQRRNELKRSP | 94 |
| hRNPA1 M9 | NQSSNFGPMKGGNFGGRSSGPYGGGGQYFAKPRNQGGY | 95 |
| IBB domain from importin-alpha | RMRIZFKNKGKDTAELRRRRVEVSVELRKAKKDEQILKRRNV | 96 |
| myoma T protein | VSRKRPRP | 97 |
| | PPKKARED | 98 |
| human p53 | PQPKKKPL | 99 |
| mouse c-abl IV | SALIKKKKKMAP | 100 |
| influenza virus NS1 | DRLRR | 117 |
| | PKQKKRK | 118 |
| Hepatitis virus delta antigen | RKLKKKIKKL | 119 |
| mouse Mx1 protein | REKKKFLKRR | 120 |
| human poly (ADP-ribose) polymerase | KRKGDEVDGVDEVAKKKSKK | 121 |
| steroid hormone receptors (human) glucocorticoid | RKCLQAGMNLEARKTKK | 122 |

B. Additional Components of ceDNA Vectors

The ceDNA vectors for expression of FVIII protein of the present disclosure may contain nucleotides that encode other components for gene expression. For example, to select for specific gene targeting events, a protective shRNA may be embedded in a microRNA and inserted into a recombinant ceDNA vector designed to integrate site-specifically into the highly active locus, such as an albumin locus. Such embodiments may provide a system for in vivo selection and expansion of gene-modified hepatocytes in any genetic background such as described in Nygaard et al., A universal system to select gene-modified hepatocytes in vivo, Gene Therapy, Jun. 8, 2016. The ceDNA vectors of the present disclosure may contain one or more selectable markers that permit selection of transformed, transfected, transduced, or the like cells. A selectable marker is a gene the product of which provides for biocide or viral resistance, resistance to heavy metals, prototrophy to auxotrophs, NeoR, and the like. In certain embodiments, positive selection markers are incorporated into the donor sequences such as NeoR. Negative selections markers may be incorporated downstream the donor sequences, for example a nucleic acid sequence HSV-tk encoding a negative selection marker may be incorporated into a nucleic acid construct downstream the donor sequence.

C. Regulatory Switches

A molecular regulatory switch is one which generates a measurable change in state in response to a signal. Such regulatory switches can be usefully combined with the ceDNA vectors for expression of FVIII protein as described herein to control the output of expression of FVIII protein from the ceDNA vector. In some embodiments, the ceDNA vector for expression of FVIII protein comprises a regulatory switch that serves to fine tune expression of the FVIII protein. For example, it can serve as a biocontainment function of the ceDNA vector. In some embodiments, the switch is an "ON/OFF" switch that is designed to start or stop (i.e., shut down) expression of FVIII protein in the ceDNA vector in a controllable and regulatable fashion. In some embodiments, the switch can include a "kill switch" that can instruct the cell comprising the ceDNA vector to undergo cell programmed death once the switch is activated. Exemplary regulatory switches encompassed for use in a ceDNA vector for expression of FVIII protein can be used to regulate the expression of a transgene, and are more fully discussed in International application PCT/US18/49996, which is incorporated herein in its entirety by reference (i) Binary Regulatory Switches In some embodiments, the ceDNA vector for expression of FVIII protein comprises a regulatory switch that can serve to controllably modulate expression of FVIII protein. For example, the expression cassette located between the ITRs of the ceDNA vector may additionally comprise a regulatory region, e.g., a promoter, cis-element, repressor, enhancer etc., that is operatively linked to the nucleic acid sequence encoding FVIII protein, where the regulatory region is regulated by one or more cofactors or exogenous agents. By way of example only, regulatory regions can be modulated by small molecule switches or inducible or repressible promoters. Non-limiting examples of inducible promoters are hormone-inducible or metal-inducible promoters. Other exemplary inducible promoters/enhancer elements include, but are not limited to, an RU486-inducible promoter, an ecdysone-inducible promoter, a rapamycin-inducible promoter, and a metallothionein promoter.

(ii) Small molecule Regulatory Switches

A variety of art-known small-molecule based regulatory switches are known in the art and can be combined with the ceDNA vectors for expression of FVIII protein as disclosed herein to form a regulatory-switch controlled ceDNA vector. In some embodiments, the regulatory switch can be selected from any one or a combination of: an orthogonal ligand/nuclear receptor pair, for example retinoid receptor variant/LG335 and GRQCIMFI, along with an artificial promoter controlling expression of the operatively linked transgene, such as that as disclosed in Taylor, et al. BMC Biotechnology 10 (2010): 15; engineered steroid receptors, e.g., modified progesterone receptor with a C-terminal truncation that cannot bind progesterone but binds RU486 (mifepristone) (U.S. Pat. No. 5,364,791); an ecdysone receptor from *Drosophila* and their ecdysteroid ligands (Saez, et al., PNAS, 97(26)(2000), 14512-14517; or a switch controlled by the antibiotic trimethoprim (TMP), as disclosed in Sando R 3$^{rd}$; Nat Methods. 2013, 10(11):1085-8. In some embodiments, the regulatory switch to control the transgene or expressed by the ceDNA vector is a pro-drug activation switch, such as that disclosed in U.S. Pat. Nos. 8,771,679, and 6,339,070.

(iii) "Passcode" Regulatory Switches

In some embodiments the regulatory switch can be a "passcode switch" or "passcode circuit". Passcode switches allow fine tuning of the control of the expression of the transgene from the ceDNA vector when specific conditions occur—that is, a combination of conditions need to be present for transgene expression and/or repression to occur. For example, for expression of a transgene to occur at least conditions A and B must occur. A passcode regulatory switch can be any number of conditions, e.g., at least 2, or at least 3, or at least 4, or at least 5, or at least 6 or at least 7 or more conditions to be present for transgene expression to occur. In some embodiments, at least 2 conditions (e.g., A, B conditions) need to occur, and in some embodiments, at least 3 conditions need to occur (e.g., A, B and C, or A, B and D). By way of an example only, for gene expression from a ceDNA to occur that has a passcode "ABC" regulatory switch, conditions A, B and C must be present. Conditions A, B and C could be as follows; condition A is the presence of a condition or disease, condition B is a hormonal response, and condition C is a response to the transgene expression. For example, if the transgene edits a defective EPO gene, Condition A is the presence of Chronic Kidney Disease (CKD), Condition B occurs if the subject has hypoxic conditions in the kidney, Condition C is that Erythropoietin-producing cells (EPC) recruitment in the kidney is impaired; or alternatively, HIF-2 activation is impaired. Once the oxygen levels increase or the desired level of EPO is reached, the transgene turns off again until 3 conditions occur, turning it back on.

In some embodiments, a passcode regulatory switch or "Passcode circuit" encompassed for use in the ceDNA vector comprises hybrid transcription factors (TFs) to expand the range and complexity of environmental signals used to define biocontainment conditions. As opposed to a deadman switch which triggers cell death in the presence of a predetermined condition, the "passcode circuit" allows cell survival or transgene expression in the presence of a particular "passcode", and can be easily reprogrammed to allow transgene expression and/or cell survival only when the predetermined environmental condition or passcode is present.

Any and all combinations of regulatory switches disclosed herein, e.g., small molecule switches, nucleic acid-based switches, small molecule-nucleic acid hybrid switches, post-transcriptional transgene regulation switches, post-translational regulation, radiation-controlled switches, hypoxia-mediated switches and other regulatory switches known by persons of ordinary skill in the art as disclosed herein can be used in a passcode regulatory switch as disclosed herein. Regulatory switches encompassed for use are also discussed in the review article Kis et al., J R Soc Interface. 12: 20141000 (2015), and summarized in Table 1 of Kis. In some embodiments, a regulatory switch for use in a passcode system can be selected from any or a combination of the switches disclosed in Table 11 of International Patent Application PCT/US18/49996, which is incorporated herein in its entirety by reference.

(iv) Nucleic Acid-Based Regulatory Switches to Control Transgene Expression

In some embodiments, the regulatory switch to control the expression of FVIII protein by the ceDNA is based on a nucleic acid based control mechanism. Exemplary nucleic acid control mechanisms are known in the art and are envisioned for use. For example, such mechanisms include riboswitches, such as those disclosed in, e.g., US2009/0305253, US2008/0269258, US2017/0204477, WO2018026762A1, U.S. Pat. No. 9,222,093 and EP application EP288071, and disclosed in the review by Villa J K et al., Microbiol Spectr. 2018 May; 6(3). Also included are metabolite-responsive transcription biosensors, such as those disclosed in WO2018/075486 and WO2017/147585. Other art-known mechanisms envisioned for use include silencing of the transgene with an siRNA or RNAi molecule (e.g., miR, shRNA). For example, the ceDNA vector can comprise a regulatory switch that encodes a RNAi molecule that is complementary to the two part of the transgene expressed by the ceDNA vector. When such RNAi is expressed even if the transgene (e.g., FVIII protein) is expressed by the ceDNA vector, it will be silenced by the complementary RNAi molecule, and when the RNAi is not expressed when the transgene is expressed by the ceDNA vector the transgene (e.g., FVIII protein) is not silenced by the RNAi.

In some embodiments, the regulatory switch is a tissue-specific self-inactivating regulatory switch, for example as disclosed in US2002/0022018, whereby the regulatory switch deliberately switches transgene (e.g., FVIII protein) off at a site where transgene expression might otherwise be disadvantageous. In some embodiments, the regulatory switch is a recombinase reversible gene expression system, for example as disclosed in US2014/0127162 and U.S. Pat. No. 8,324,436.

(v) Post-Transcriptional and Post-Translational Regulatory Switches.

In some embodiments, the regulatory switch to control the expression of FVIII protein by the ceDNA vector is a post-transcriptional modification system. For example, such a regulatory switch can be an aptazyme riboswitch that is sensitive to tetracycline or theophylline, as disclosed in US2018/0119156, GB201107768, WO2001/064956A3, EP Patent 2707487 and Beilstein et al., ACS Synth. Biol., 2015, 4 (5), pp 526-534; Zhong et al., Elife. 2016 Nov. 2; 5. pii: e18858. In some embodiments, it is envisioned that a person of ordinary skill in the art could encode both the transgene and an inhibitory siRNA which contains a ligand sensitive (OFF-switch) aptamer, the net result being a ligand sensitive ON-switch.

(vi) Other Exemplary Regulatory Switches

Any known regulatory switch can be used in the ceDNA vector to control the expression of FVIII protein by the ceDNA vector, including those triggered by environmental changes. Additional examples include, but are not limited to; the BOC method of Suzuki et al., Scientific Reports 8; 10051 (2018); genetic code expansion and a non-physiologic amino acid; radiation-controlled or ultra-sound controlled on/off switches (see, e.g., Scott S et al., Gene Ther. 2000 July; 7(13):1121-5; U.S. Pat. Nos. 5,612,318; 5,571,797; 5,770,581; 5,817,636; and WO1999/025385A1. In some embodiments, the regulatory switch is controlled by an implantable system, e.g., as disclosed in U.S. Pat. No. 7,840,263; US2007/0190028A1 where gene expression is controlled by one or more forms of energy, including electromagnetic energy, that activates promoters operatively linked to the transgene in the ceDNA vector.

In some embodiments, a regulatory switch envisioned for use in the ceDNA vector is a hypoxia-mediated or stress-activated switch, e.g., such as those disclosed in WO1999060142A2, U.S. Pat. Nos. 5,834,306; 6,218,179; 6,709,858; US2015/0322410; Greco et al., (2004) Targeted Cancer Therapies 9, 5368, as well as FROG, TOAD and NRSE elements and conditionally inducible silence elements, including hypoxia response elements (HREs), inflammatory response elements (IREs) and shear-stress activated elements (SSAEs), e.g., as disclosed in U.S. Pat. No. 9,394,526. Such an embodiment is useful for turning on expression of the transgene from the ceDNA vector after ischemia or in ischemic tissues, and/or tumors.

(vii) Kill Switches

Other embodiments described herein relate to a ceDNA vector for expression of FVIII protein as described herein comprising a kill switch. A kill switch as disclosed herein enables a cell comprising the ceDNA vector to be killed or undergo programmed cell death as a means to permanently remove an introduced ceDNA vector from the subject's system. It will be appreciated by one of ordinary skill in the art that use of kill switches in the ceDNA vectors for expression of FVIII protein would be typically coupled with targeting of the ceDNA vector to a limited number of cells that the subject can acceptably lose or to a cell type where apoptosis is desirable (e.g., cancer cells). In all aspects, a "kill switch" as disclosed herein is designed to provide rapid and robust cell killing of the cell comprising the ceDNA vector in the absence of an input survival signal or other specified condition. Stated another way, a kill switch encoded by a ceDNA vector for expression of FVIII protein as described herein can restrict cell survival of a cell comprising a ceDNA vector to an environment defined by specific input signals. Such kill switches serve as a biological biocontainment function should it be desirable to remove the ceDNA vector e expression of FVIII protein in a subject or to ensure that it will not express the encoded FVIII protein.

Other kill switches known to a person of ordinary skill in the art are encompassed for use in the ceDNA vector for expression of FVIII protein as disclosed herein, e.g., as disclosed in 052010/0175141; 052013/0009799; 052011/0172826; 052013/0109568, as well as kill switches disclosed in Jusiak et al., Reviews in Cell Biology and molecular Medicine; 2014; 1-56; Kobayashi et al., PNAS, 2004; 101; 8419-9; Marchisio et al., Int. Journal of Biochem and Cell Biol., 2011; 43; 310-319; and in Reinshagen et al., Science Translational Medicine, 2018, 11.

Accordingly, in some embodiments, the ceDNA vector for expression of FVIII protein can comprise a kill switch nucleic acid construct, which comprises the nucleic acid encoding an effector toxin or reporter protein, where the expression of the effector toxin (e.g., a death protein) or reporter protein is controlled by a predetermined condition. For example, a predetermined condition can be the presence of an environmental agent, such as, e.g., an exogenous agent, without which the cell will default to expression of the effector toxin (e.g., a death protein) and be killed. In alternative embodiments, a predetermined condition is the presence of two or more environmental agents, e.g., the cell will only survive when two or more necessary exogenous agents are supplied, and without either of which, the cell comprising the ceDNA vector is killed.

In some embodiments, the ceDNA vector for expression of FVIII protein is modified to incorporate a kill-switch to destroy the cells comprising the ceDNA vector to effectively terminate the in vivo expression of the transgene being expressed by the ceDNA vector (e.g., expression of FVIII protein). Specifically, the ceDNA vector is further genetically engineered to express a switch-protein that is not functional in mammalian cells under normal physiological conditions. Only upon administration of a drug or environmental condition that specifically targets this switch-protein, the cells expressing the switch-protein will be destroyed thereby terminating the expression of the therapeutic protein or peptide. For instance, it was reported that cells expressing HSV-thymidine kinase can be killed upon administration of drugs, such as ganciclovir and cytosine deaminase. See, for example, Dey and Evans, Suicide Gene Therapy by Herpes Simplex Virus-1 Thymidine Kinase (HSV-TK), in Targets in Gene Therapy, edited by You (2011); and Beltinger et al., Proc. Natl. Acad. Sci. USA 96(15):8699-8704 (1999). In some embodiments the ceDNA vector can comprise a siRNA kill switch referred to as DISE (Death Induced by Survival gene Elimination) (Murmann et al., Oncotarget. 2017; 8:84643-84658. Induction of DISE in ovarian cancer cells in vivo).

VI. Detailed Method of Production of a ceDNA Vector

A. Production in General

Certain methods for the production of a ceDNA vector for expression of FVIII protein comprising an asymmetrical ITR pair or symmetrical ITR pair as defined herein is described in section IV of International application PCT/US18/49996 filed Sep. 7, 2018, which is incorporated herein in its entirety by reference. In some embodiments, a ceDNA vector for expression of FVIII protein as disclosed herein can be produced using insect cells, as described herein. In alternative embodiments, a ceDNA vector for expression of FVIII protein as disclosed herein can be produced synthetically and in some embodiments, in a cell-free method, as disclosed on International Application PCT/US19/14122, filed Jan. 18, 2019, which is incorporated herein in its entirety by reference.

As described herein, in one embodiment, a ceDNA vector for expression of FVIII protein can be obtained, for example, by the process comprising the steps of: a) incubating a population of host cells (e.g. insect cells) harboring the polynucleotide expression construct template (e.g., a ceDNA-plasmid, a ceDNA-Bacmid, and/or a ceDNA-baculovirus), which is devoid of viral capsid coding sequences, in the presence of a Rep protein under conditions effective and for a time sufficient to induce production of the ceDNA vector within the host cells, and wherein the host cells do not comprise viral capsid coding sequences; and b) harvesting and isolating the ceDNA vector from the host cells. The presence of Rep protein induces replication of the vector polynucleotide with a modified ITR to produce the ceDNA vector in a host cell. However, no viral particles (e.g. AAV virions) are expressed. Thus, there is no size limitation such as that naturally imposed in AAV or other viral-based vectors.

The presence of the ceDNA vector isolated from the host cells can be confirmed by digesting DNA isolated from the host cell with a restriction enzyme having a single recognition site on the ceDNA vector and analyzing the digested DNA material on a non-denaturing gel to confirm the presence of characteristic bands of linear and continuous DNA as compared to linear and non-continuous DNA.

In yet another aspect, the invention provides for use of host cell lines that have stably integrated the DNA vector polynucleotide expression template (ceDNA template) into their own genome in production of the non-viral DNA vector, e.g. as described in Lee, L. et al. (2013) Plos One 8(8): e69879. Preferably, Rep is added to host cells at an MOI of about 3. When the host cell line is a mammalian cell line, e.g., HEK293 cells, the cell lines can have polynucleotide vector template stably integrated, and a second vector such as herpes virus can be used to introduce Rep protein into cells, allowing for the excision and amplification of ceDNA in the presence of Rep and helper virus.

In one embodiment, the host cells used to make the ceDNA vectors for expression of FVIII protein as described herein are insect cells, and baculovirus is used to deliver both the polynucleotide that encodes Rep protein and the non-viral DNA vector polynucleotide expression construct template for ceDNA, e.g., as described in FIGS. 4A-4C and Example 1. In some embodiments, the host cell is engineered to express Rep protein.

The ceDNA vector is then harvested and isolated from the host cells. The time for harvesting and collecting ceDNA vectors described herein from the cells can be selected and optimized to achieve a high-yield production of the ceDNA vectors. For example, the harvest time can be selected in view of cell viability, cell morphology, cell growth, etc. In one embodiment, cells are grown under sufficient conditions and harvested a sufficient time after baculoviral infection to produce ceDNA vectors but before a majority of cells start to die because of the baculoviral toxicity. The DNA vectors can be isolated using plasmid purification kits such as Qiagen Endo-Free Plasmid kits. Other methods developed for plasmid isolation can be also adapted for DNA vectors. Generally, any nucleic acid purification methods can be adopted.

The DNA vectors can be purified by any means known to those of skill in the art for purification of DNA. In one embodiment, ceDNA vectors are purified as DNA molecules. In another embodiment, the ceDNA vectors are purified as exosomes or microparticles.

The presence of the ceDNA vector for expression of FVIII protein can be confirmed by digesting the vector DNA isolated from the cells with a restriction enzyme having a single recognition site on the DNA vector and analyzing both digested and undigested DNA material using gel electrophoresis to confirm the presence of characteristic bands of linear and continuous DNA as compared to linear and non-continuous DNA. FIG. 4C and FIG. 4D illustrate one embodiment for identifying the presence of the closed ended ceDNA vectors produced by the processes herein.

B. ceDNA Plasmid

A ceDNA-plasmid is a plasmid used for later production of a ceDNA vector for expression of FVIII protein. In some embodiments, a ceDNA-plasmid can be constructed using known techniques to provide at least the following as operatively linked components in the direction of transcription: (1) a modified 5' ITR sequence; (2) an expression cassette containing a cis-regulatory element, for example, a promoter, inducible promoter, regulatory switch, enhancers and the like; and (3) a modified 3' ITR sequence, where the 3' ITR sequence is symmetric relative to the 5' ITR sequence. In some embodiments, the expression cassette flanked by the ITRs comprises a cloning site for introducing an exogenous sequence. The expression cassette replaces the rep and cap coding regions of the AAV genomes.

In one aspect, a ceDNA vector for expression of FVIII protein is obtained from a plasmid, referred to herein as a "ceDNA-plasmid" encoding in this order: a first adeno-associated virus (AAV) inverted terminal repeat (ITR), an expression cassette comprising a transgene, and a mutated or modified AAV ITR, wherein said ceDNA-plasmid is devoid of AAV capsid protein coding sequences. In alternative embodiments, the ceDNA-plasmid encodes in this order: a first (or 5') modified or mutated AAV ITR, an expression cassette comprising a transgene, and a second (or 3') modified AAV ITR, wherein said ceDNA-plasmid is devoid of AAV capsid protein coding sequences, and wherein the 5' and 3' ITRs are symmetric relative to each other. In alternative embodiments, the ceDNA-plasmid encodes in this order: a first (or 5') modified or mutated AAV ITR, an expression cassette comprising a transgene, and a second (or 3') mutated or modified AAV ITR, wherein said ceDNA-plasmid is devoid of AAV capsid protein coding sequences, and wherein the 5' and 3' modified ITRs are have the same modifications (i.e., they are inverse complement or symmetric relative to each other).

In a further embodiment, the ceDNA-plasmid system is devoid of viral capsid protein coding sequences (i.e. it is devoid of AAV capsid genes but also of capsid genes of other viruses). In addition, in a particular embodiment, the ceDNA-plasmid is also devoid of AAV Rep protein coding sequences. Accordingly, in a preferred embodiment, ceDNA-plasmid is devoid of functional AAV cap and AAV rep genes GG-3' for AAV2) plus a variable palindromic sequence allowing for hairpin formation.

A ceDNA-plasmid of the present invention can be generated using natural nucleotide sequences of the genomes of any AAV serotypes well known in the art. In one embodiment, the ceDNA-plasmid backbone is derived from the AAV1, AAV2, AAV3, AAV4, AAV5, AAV 5, AAV7, AAV8, AAV9, AAV10, AAV 11, AAV12, AAVrh8, AAVrh10, AAV-DJ, and AAV-DJ8 genome. E.g., NCBI: NC 002077; NC 001401; NC001729; NC001829; NC006152; NC 006260; NC 006261; Kotin and Smith, The Springer Index of Viruses, available at the URL maintained by Springer (at www web address: oesys.springer.de/viruses/database/mkchapter.asp?virID=42.04.)(note -references to a URL or database refer to the contents of the URL or database as of the effective filing date of this application) In a particular embodiment, the ceDNA-plasmid backbone is derived from the AAV2 genome. In another particular embodiment, the ceDNA-plasmid backbone is a synthetic backbone genetically engineered to include at its 5' and 3' ITRs derived from one of these AAV genomes.

A ceDNA-plasmid can optionally include a selectable or selection marker for use in the establishment of a ceDNA vector-producing cell line. In one embodiment, the selection marker can be inserted downstream (i.e., 3') of the 3' ITR sequence. In another embodiment, the selection marker can be inserted upstream (i.e., 5') of the 5' ITR sequence. Appropriate selection markers include, for example, those that confer drug resistance. Selection markers can be, for example, a blasticidin S-resistance gene, kanamycin, geneticin, and the like. In a preferred embodiment, the drug selection marker is a blasticidin S-resistance gene.

An exemplary ceDNA (e.g., rAAV0) vector for expression of FVIII protein is produced from an rAAV plasmid. A method for the production of a rAAV vector, can comprise: (a) providing a host cell with a rAAV plasmid as described above, wherein both the host cell and the plasmid are devoid of capsid protein encoding genes, (b) culturing the host cell under conditions allowing production of an ceDNA genome, and (c) harvesting the cells and isolating the AAV genome produced from said cells.

C. Exemplary Method of Making the ceDNA Vectors from ceDNA Plasmids

Methods for making capsid-less ceDNA vectors for expression of FVIII protein are also provided herein, notably a method with a sufficiently high yield to provide sufficient vector for in vivo experiments.

In some embodiments, a method for the production of a ceDNA vector for expression of FVIII protein comprises the steps of: (1) introducing the nucleic acid construct comprising an expression cassette and two symmetric ITR sequences into a host cell (e.g., Sf9 cells), (2) optionally, establishing a clonal cell line, for example, by using a selection marker present on the plasmid, (3) introducing a Rep coding gene (either by transfection or infection with a baculovirus carrying said gene) into said insect cell, and (4) harvesting the cell and purifying the ceDNA vector. The nucleic acid construct comprising an expression cassette and two ITR sequences described above for the production of ceDNA vector can be in the form of a ceDNA plasmid, or Bacmid or Baculovirus generated with the ceDNA plasmid as described below. The nucleic acid construct can be introduced into a host cell by transfection, viral transduction, stable integration, or other methods known in the art.

D. Cell Lines

Host cell lines used in the production of a ceDNA vector for expression of FVIII protein can include insect cell lines derived from *Spodoptera frugiperda*, such as Sf9 Sf21, or *Trichoplusia ni* cell, or other invertebrate, vertebrate, or other eukaryotic cell lines including mammalian cells. Other cell lines known to an ordinarily skilled artisan can also be used, such as HEK293, Huh-7, HeLa, HepG2, HeplA, 911, CHO, COS, MeWo, NIH3T3, A549, HT1 180, monocytes, and mature and immature dendritic cells. Host cell lines can be transfected for stable expression of the ceDNA-plasmid for high yield ceDNA vector production.

CeDNA-plasmids can be introduced into Sf9 cells by transient transfection using reagents (e.g., liposomal, calcium phosphate) or physical means (e.g., electroporation) known in the art. Alternatively, stable Sf9 cell lines which have stably integrated the ceDNA-plasmid into their genomes can be established. Such stable cell lines can be established by incorporating a selection marker into the ceDNA-plasmid as described above. If the ceDNA-plasmid used to transfect the cell line includes a selection marker, such as an antibiotic, cells that have been transfected with the ceDNA-plasmid and integrated the ceDNA-plasmid DNA into their genome can be selected for by addition of the antibiotic to the cell growth media. Resistant clones of the cells can then be isolated by single-cell dilution or colony transfer techniques and propagated.

E. Isolating and Purifying ceDNA Vectors:

Examples of the process for obtaining and isolating ceDNA vectors are described in FIGS. 4A-4E and the specific examples below. ceDNA-vectors for expression of FVIII protein disclosed herein can be obtained from a producer cell expressing AAV Rep protein(s), further transformed with a ceDNA-plasmid, ceDNA-bacmid, or ceDNA-baculovirus. Plasmids useful for the production of ceDNA vectors include plasmids that encode FVIII protein, or plasmids encoding one or more REP proteins.

In one aspect, a polynucleotide encodes the AAV Rep protein (Rep 78 or 68) delivered to a producer cell in a plasmid (Rep-plasmid), a bacmid (Rep-bacmid), or a baculovirus (Rep-baculovirus). The Rep-plasmid, Rep-bacmid, and Rep-baculovirus can be generated by methods described above.

Methods to produce a ceDNA vector for expression of FVIII protein are described herein. Expression constructs used for generating a ceDNA vector for expression of FVIII protein as described herein can be a plasmid (e.g., ceDNA-plasmids), a Bacmid (e.g., ceDNA-bacmid), and/or a baculovirus (e.g., ceDNA-baculovirus). By way of an example only, a ceDNA-vector can be generated from the cells co-infected with ceDNA-baculovirus and Rep-baculovirus. Rep proteins produced from the Rep-baculovirus can replicate the ceDNA-baculovirus to generate ceDNA-vectors. Alternatively, ceDNA vectors for expression of FVIII protein can be generated from the cells stably transfected with a construct comprising a sequence encoding the AAV Rep protein (Rep78/52) delivered in Rep-plasmids, Rep-bacmids, or Rep-baculovirus. CeDNA-Baculovirus can be transiently transfected to the cells, be replicated by Rep protein and produce ceDNA vectors.

The bacmid (e.g., ceDNA-bacmid) can be transfected into permissive insect cells such as Sf9, Sf21, Tni (*Trichoplusia ni*) cell, High Five cell, and generate ceDNA-baculovirus, which is a recombinant baculovirus including the sequences comprising the symmetric ITRs and the expression cassette. ceDNA-baculovirus can be again infected into the insect cells to obtain a next generation of the recombinant baculovirus. Optionally, the step can be repeated once or multiple times to produce the recombinant baculovirus in a larger quantity.

The time for harvesting and collecting ceDNA vectors for expression of FVIII protein as described herein from the cells can be selected and optimized to achieve a high-yield production of the ceDNA vectors. For example, the harvest time can be selected in view of cell viability, cell morphology, cell growth, etc. Usually, cells can be harvested after sufficient time after baculoviral infection to produce ceDNA vectors (e.g., ceDNA vectors) but before majority of cells start to die because of the viral toxicity. The ceDNA-vectors can be isolated from the Sf9 cells using plasmid purification kits such as Qiagen ENDO-FREE PLASMID® kits. Other methods developed for plasmid isolation can be also adapted for ceDNA vectors. Generally, any art-known nucleic acid purification methods can be adopted, as well as commercially available DNA extraction kits.

Alternatively, purification can be implemented by subjecting a cell pellet to an alkaline lysis process, centrifuging the resulting lysate and performing chromatographic separation. As one non-limiting example, the process can be performed by loading the supernatant on an ion exchange column (e.g. SARTOBIND Q®) which retains nucleic acids, and then eluting (e.g. with a 1.2 M NaCl solution) and performing a further chromatographic purification on a gel filtration column (e.g. 6 fast flow GE). The capsid-free AAV vector is then recovered by, e.g., precipitation.

In some embodiments, ceDNA vectors for expression of FVIII protein can also be purified in the form of exosomes, or microparticles. It is known in the art that many cell types release not only soluble proteins, but also complex protein/nucleic acid cargoes via membrane microvesicle shedding (Cocucci et al, 2009; EP 10306226.1) Such vesicles include microvesicles (also referred to as microparticles) and exosomes (also referred to as nanovesicles), both of which comprise proteins and RNA as cargo. Microvesicles are generated from the direct budding of the plasma membrane, and exosomes are released into the extracellular environment upon fusion of multivesicular endosomes with the plasma membrane. Thus, ceDNA vector-containing microvesicles and/or exosomes can be isolated from cells that have been transduced with the ceDNA-plasmid or a bacmid or baculovirus generated with the ceDNA-plasmid.

Microvesicles can be isolated by subjecting culture medium to filtration or ultracentrifugation at 20,000×g, and exosomes at 100,000×g. The optimal duration of ultracentrifugation can be experimentally-determined and will depend on the particular cell type from which the vesicles are isolated. Preferably, the culture medium is first cleared by low-speed centrifugation (e.g., at 2000×g for 5-20 minutes) and subjected to spin concentration using, e.g., an AMICON® spin column (Millipore, Watford, UK). Microvesicles and exosomes can be further purified via FACS or MACS by using specific antibodies that recognize specific surface antigens present on the microvesicles and exosomes. Other microvesicle and exosome purification methods include, but are not limited to, immunoprecipitation, affinity chromatography, filtration, and magnetic beads coated with specific antibodies or aptamers. Upon purification, vesicles are washed with, e.g., phosphate-buffered saline. One advantage of using microvesicles or exosome to deliver ceDNA-containing vesicles is that these vesicles can be targeted to various cell types by including on their membrane proteins recognized by specific receptors on the respective cell types. (See also EP 10306226)

Another aspect of the invention herein relates to methods of purifying ceDNA vectors from host cell lines that have stably integrated a ceDNA construct into their own genome. In one embodiment, ceDNA vectors are purified as DNA molecules. In another embodiment, the ceDNA vectors are purified as exosomes or microparticles.

FIG. 5 of International application PCT/US18/49996 shows a gel confirming the production of ceDNA from multiple ceDNA-plasmid constructs using the method described in the Examples. The ceDNA is confirmed by a characteristic band pattern in the gel, as discussed with respect to FIG. 4D in the Examples.

VII. Pharmaceutical Compositions

In another aspect, pharmaceutical compositions are provided. The pharmaceutical composition comprises a ceDNA vector for expression of FVIII protein as described herein and a pharmaceutically acceptable carrier or diluent.

The ceDNA vectors for expression of FVIII protein as disclosed herein can be incorporated into pharmaceutical compositions suitable for administration to a subject for in vivo delivery to cells, tissues, or organs of the subject. Typically, the pharmaceutical composition comprises a ceDNA-vector as disclosed herein and a pharmaceutically acceptable carrier. For example, the ceDNA vectors for expression of FVIII protein as described herein can be incorporated into a pharmaceutical composition suitable for a desired route of therapeutic administration (e.g., parenteral administration). Passive tissue transduction via high pressure intravenous or intra-arterial infusion, as well as intracellular injection, such as intranuclear microinjection or intracytoplasmic injection, are also contemplated. Pharmaceutical compositions for therapeutic purposes can be formulated as a solution, microemulsion, dispersion, liposomes, or other ordered structure suitable to high ceDNA vector concentration. Sterile injectable solutions can be prepared by incorporating the ceDNA vector compound in the required amount in an appropriate buffer with one or a combination of ingredients enumerated above, as required, followed by filtered sterilization including a ceDNA vector can be formulated to deliver a transgene in the nucleic acid to the cells of a recipient, resulting in the therapeutic expression of the transgene or donor sequence therein. The composition can also include a pharmaceutically acceptable carrier.

Pharmaceutically active compositions comprising a ceDNA vector for expression of FVIII protein can be formulated to deliver a transgene for various purposes to the cell, e.g., cells of a subject.

Pharmaceutical compositions for therapeutic purposes typically must be sterile and stable under the conditions of manufacture and storage. The composition can be formulated as a solution, microemulsion, dispersion, liposomes, or other ordered structure suitable to high ceDNA vector concentration. Sterile injectable solutions can be prepared by incorporating the ceDNA vector compound in the required amount in an appropriate buffer with one or a combination of ingredients enumerated above, as required, followed by filtered sterilization.

A ceDNA vector for expression of FVIII protein as disclosed herein can be incorporated into a pharmaceutical composition suitable for topical, systemic, intra-amniotic, intrathecal, intracranial, intra-arterial, intravenous, intralymphatic, intraperitoneal, subcutaneous, tracheal, intra-tissue (e.g., intramuscular, intracardiac, intrahepatic, intrarenal, intracerebral), intrathecal, intravesical, conjunctival (e.g., extra-orbital, intraorbital, retroorbital, intraretinal, subretinal, choroidal, sub-choroidal, intrastromal, intracameral and intravitreal), intracochlear, and mucosal (e.g., oral, rectal, nasal) administration. Passive tissue transduction via high pressure intravenous or intraarterial infusion, as well as intracellular injection, such as intranuclear microinjection or intracytoplasmic injection, are also contemplated.

In some aspects, the methods provided herein comprise delivering one or more ceDNA vectors for expression of FVIII protein as disclosed herein to a host cell. Also provided herein are cells produced by such methods, and organisms (such as animals, plants, or fungi) comprising or produced from such cells. Methods of delivery of nucleic acids can include lipofection, nucleofection, microinjection, biolistics, liposomes, immunoliposomes, polycation or lipid: nucleic acid conjugates, naked DNA, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Delivery can be to cells (e.g., in vitro or ex vivo administration) or target tissues (e.g., in vivo administration).

Various techniques and methods are known in the art for delivering nucleic acids to cells. For example, nucleic acids, such as ceDNA for expression of FVIII protein can be formulated into lipid nanoparticles (LNPs), lipidoids, liposomes, lipid nanoparticles, lipoplexes, or core-shell nanoparticles. Typically, LNPs are composed of nucleic acid (e.g., ceDNA) molecules, one or more ionizable or cationic lipids (or salts thereof), one or more non-ionic or neutral lipids (e.g., a phospholipid), a molecule that prevents aggregation (e.g., PEG or a PEG-lipid conjugate), and optionally a sterol (e.g., cholesterol).

Another method for delivering nucleic acids, such as ceDNA for expression of FVIII protein to a cell is by conjugating the nucleic acid with a ligand that is internalized by the cell. For example, the ligand can bind a receptor on the cell surface and internalized via endocytosis. The ligand can be covalently linked to a nucleotide in the nucleic acid. Exemplary conjugates for delivering nucleic acids into a cell are described, example, in WO2015/006740, WO2014/025805, WO2012/037254, WO2009/082606, WO2009/073809, WO2009/018332, WO2006/112872, WO2004/090108, WO2004/091515 and WO2017/177326.

Nucleic acids, such as ceDNA vectors for expression of FVIII protein can also be delivered to a cell by transfection. Useful transfection methods include, but are not limited to, lipid-mediated transfection, cationic polymer-mediated transfection, or calcium phosphate precipitation. Transfection reagents are well known in the art and include, but are not limited to, TurboFect Transfection Reagent (Thermo Fisher Scientific), Pro-Ject Reagent (Thermo Fisher Scientific), TRANSPASS™ P Protein Transfection Reagent (New England Biolabs), CHARIOT™ Protein Delivery Reagent (Active Motif), PROTEOJUICE™ Protein Transfection Reagent (EMD Millipore), 293fectin, LIPOFECTAMINE™ 2000, LIPOFECTAMINE™ 3000 (Thermo Fisher Scientific), LIPOFECTAMINE™ (Thermo Fisher Scientific), LIPOFECTIN™ (Thermo Fisher Scientific), DMRIE-C, CELLFECTIN™ (Thermo Fisher Scientific), OLIGOFECTAMINE™ (Thermo Fisher Scientific), LIPOFECTACE™, FUGENE™ (Roche, Basel, Switzerland), FUGENE™ HD (Roche), TRANSFECTAM™ (Transfectam, Promega, Madison, Wis.), TFX-10™ (Promega), TFX-20™ (Promega), TFX-50™ (Promega), TRANSFECTIN™ (BioRad, Hercules, Calif.), SILENTFECT™ (Bio-Rad), Effectene™ (Qiagen, Valencia, Calif.), DC-chol (Avanti Polar Lipids), GENEPORTER™ (Gene Therapy Systems, San Diego, Calif.), DHARMAFECT 1™ (Dharmacon, Lafayette, Colo.), DHARMAFECT 2™ (Dharmacon), DHARMAFECT 3™ (Dharmacon), DHARMAFECT 4™ (Dharmacon), ESCORT™ III (Sigma, St. Louis, Mo.), and ESCORT™ IV (Sigma Chemical Co.). Nucleic acids, such as ceDNA, can also be delivered to a cell via microfluidics methods known to those of skill in the art.

ceDNA vectors for expression of FVIII protein as described herein can also be administered directly to an organism for transduction of cells in vivo. Administration is by any of the routes normally used for introducing a molecule into ultimate contact with blood or tissue cells including, but not limited to, injection, infusion, topical application and electroporation. Suitable methods of administering such nucleic acids are available and well known to those of skill in the art, and, although more than one route can be used to administer a particular composition, a particular route can often provide a more immediate and more effective reaction than another route.

Methods for introduction of a nucleic acid vector ceDNA vector for expression of FVIII protein as disclosed herein can be delivered into hematopoietic stem cells, for example, by the methods as described, for example, in U.S. Pat. No. 5,928,638.

The ceDNA vectors for expression of FVIII protein in accordance with the present invention can be added to liposomes for delivery to a cell or target organ in a subject. Liposomes are vesicles that possess at least one lipid bilayer. Liposomes are typical used as carriers for drug/therapeutic delivery in the context of pharmaceutical development. They work by fusing with a cellular membrane and repositioning its lipid structure to deliver a drug or active pharmaceutical ingredient (API). Liposome compositions for such delivery are composed of phospholipids, especially compounds having a phosphatidylcholine group, however these compositions may also include other lipids. Exemplary liposomes and liposome formulations, including but not limited to polyethylene glycol (PEG)-functional group containing compounds are disclosed in International Application PCT/US2018/050042, filed on Sep. 7, 2018 and in International application PCT/US2018/064242, filed on Dec. 6, 2018, e.g., see the section entitled "Pharmaceutical Formulations".

Various delivery methods known in the art or modification thereof can be used to deliver ceDNA vectors in vitro or in vivo. For example, in some embodiments, ceDNA vectors for expression of FVIII protein are delivered by making transient penetration in cell membrane by mechanical, electrical, ultrasonic, hydrodynamic, or laser-based energy so that DNA entrance into the targeted cells is facilitated. For example, a ceDNA vector can be delivered by transiently disrupting cell membrane by squeezing the cell through a size-restricted channel or by other means known in the art. In some cases, a ceDNA vector alone is directly injected as naked DNA into any one of: any one or more tissues selected from: liver, kidneys, gallbladder, prostate, adrenal gland, heart, intestine, lung, and stomach, skin, thymus, cardiac muscle or skeletal muscle. In some cases, a ceDNA vector is delivered by gene gun. Gold or tungsten spherical particles (1-3 μm diameter) coated with capsid-free AAV vectors can be accelerated to high speed by pressurized gas to penetrate into target tissue cells.

Compositions comprising a ceDNA vector for expression of FVIII protein and a pharmaceutically acceptable carrier are specifically contemplated herein. In some embodiments, the ceDNA vector is formulated with a lipid delivery system, for example, liposomes as described herein. In some embodiments, such compositions are administered by any route desired by a skilled practitioner. The compositions may be administered to a subject by different routes including orally, parenterally, sublingually, transdermally, rectally, transmucosally, topically, via inhalation, via buccal administration, intrapleurally, intravenous, intra-arterial, intraperitoneal, subcutaneous, intramuscular, intranasal intrathecal, and intraarticular or combinations thereof. For veterinary use, the composition may be administered as a suitably acceptable formulation in accordance with normal veterinary practice. The veterinarian may readily determine the dosing regimen and route of administration that is most appropriate for a particular animal. The compositions may be administered by traditional syringes, needleless injection devices, "microprojectile bombardment gene guns", or other physical methods such as electroporation ("EP"), hydrodynamic methods, or ultrasound.

In some cases, a ceDNA vector for expression of FVIII protein is delivered by hydrodynamic injection, which is a simple and highly efficient method for direct intracellular delivery of any water-soluble compounds and particles into internal organs and skeletal muscle in an entire limb.

In some cases, ceDNA vectors for expression of FVIII protein are delivered by ultrasound by making nanoscopic pores in membrane to facilitate intracellular delivery of DNA particles into cells of internal organs or tumors, so the size and concentration of plasmid DNA have great role in efficiency of the system. In some cases, ceDNA vectors are delivered by magnetofection by using magnetic fields to concentrate particles containing nucleic acid into the target cells.

In some cases, chemical delivery systems can be used, for example, by using nanomeric complexes, which include compaction of negatively charged nucleic acid by polycationic nanomeric particles, belonging to cationic liposome/micelle or cationic polymers. Cationic lipids used for the delivery method includes, but not limited to monovalent cationic lipids, polyvalent cationic lipids, guanidine containing compounds, cholesterol derivative compounds, cationic polymers, (e.g., poly(ethylenimine), poly-L-lysine, protamine, other cationic polymers), and lipid-polymer hybrid.

A. Exosomes

In some embodiments, a ceDNA vector for expression of FVIII protein as disclosed herein is delivered by being packaged in an exosome. Exosomes are small membrane vesicles of endocytic origin that are released into the extracellular environment following fusion of multivesicular bodies with the plasma membrane. Their surface consists of a lipid bilayer from the donor cell's cell membrane, they contain cytosol from the cell that produced the exosome, and exhibit membrane proteins from the parental cell on the surface. Exosomes are produced by various cell types including epithelial cells, B and T lymphocytes, mast cells (MC) as well as dendritic cells (DC). Some embodiments, exosomes with a diameter between 10 nm and 1 μm, between 20 nm and 500 nm, between 30 nm and 250 nm, between 50 nm and 100 nm are envisioned for use. Exosomes can be isolated for a delivery to target cells using either their donor cells or by introducing specific nucleic acids into them. Various approaches known in the art can be used to produce exosomes containing capsid-free AAV vectors of the present invention.

B. Microparticle/Nanoparticles

In some embodiments, a ceDNA vector for expression of FVIII protein as disclosed herein is delivered by a lipid nanoparticle. Generally, lipid nanoparticles comprise an ionizable amino lipid (e.g., heptatriaconta-6,9,28,31-tetraen-19-yl 4-(dimethylamino)butanoate, DLin-MC3-DMA, a phosphatidylcholine (1,2-distearoyl-sn-glycero-3-phosphocholine, DSPC), cholesterol and a coat lipid (polyethylene glycol-dimyristolglycerol, PEG-DMG), for example as disclosed by Tam et al. (2013). *Advances in Lipid Nanoparticles for siRNA delivery*. Pharmaceuticals 5(3): 498-507.

In some embodiments, a lipid nanoparticle has a mean diameter between about 10 and about 1000 nm. In some embodiments, a lipid nanoparticle has a diameter that is less than 300 nm. In some embodiments, a lipid nanoparticle has a diameter between about 10 and about 300 nm. In some embodiments, a lipid nanoparticle has a diameter that is less than 200 nm. In some embodiments, a lipid nanoparticle has a diameter between about 25 and about 200 nm. In some embodiments, a lipid nanoparticle preparation (e.g., composition comprising a plurality of lipid nanoparticles) has a size distribution in which the mean size (e.g., diameter) is about 70 nm to about 200 nm, and more typically the mean size is about 100 nm or less.

Various lipid nanoparticles known in the art can be used to deliver ceDNA vector for expression of FVIII protein as disclosed herein. For example, various delivery methods using lipid nanoparticles are described in U.S. Pat. Nos. 9,404,127, 9,006,417 and 9,518,272.

In some embodiments, a ceDNA vector for expression of FVIII protein as disclosed herein is delivered by a gold nanoparticle. Generally, a nucleic acid can be covalently bound to a gold nanoparticle or non-covalently bound to a gold nanoparticle (e.g., bound by a charge-charge interaction), for example as described by Ding et al. (2014). *Gold Nanoparticles for Nucleic Acid Delivery*. Mol. Ther. 22(6); 1075-1083. In some embodiments, gold nanoparticle-nucleic acid conjugates are produced using methods described, for example, in U.S. Pat. No. 6,812,334.

C. Conjugates

In some embodiments, a ceDNA vector for expression of FVIII protein as disclosed herein is conjugated (e.g., covalently bound to an agent that increases cellular uptake. An "agent that increases cellular uptake" is a molecule that facilitates transport of a nucleic acid across a lipid membrane. For example, a nucleic acid can be conjugated to a lipophilic compound (e.g., cholesterol, tocopherol, etc.), a cell penetrating peptide (CPP) (e.g., penetratin, TAT, Syn1B, etc.), and polyamines (e.g., spermine). Further examples of agents that increase cellular uptake are disclosed, for example, in Winkler (2013). *Oligonucleotide conjugates for therapeutic applications*. Ther. Deliv. 4(7); 791-809.

In some embodiments, a ceDNA vector for expression of FVIII protein as disclosed herein is conjugated to a polymer (e.g., a polymeric molecule) or a folate molecule (e.g., folic acid molecule). Generally, delivery of nucleic acids conjugated to polymers is known in the art, for example as described in WO2000/34343 and WO2008/022309. In some embodiments, a ceDNA vector for expression of FVIII protein as disclosed herein is conjugated to a poly(amide) polymer, for example as described by U.S. Pat. No. 8,987,377. In some embodiments, a nucleic acid described by the disclosure is conjugated to a folic acid molecule as described in U.S. Pat. No. 8,507,455.

In some embodiments, a ceDNA vector for expression of FVIII protein as disclosed herein is conjugated to a carbohydrate, for example as described in U.S. Pat. No. 8,450,467.

D. Nanocapsule

Alternatively, nanocapsule formulations of a ceDNA vector for expression of FVIII protein as disclosed herein can be used. Nanocapsules can generally entrap substances in a stable and reproducible way. To avoid side effects due to intracellular polymeric overloading, such ultrafine particles (sized around 0.1 μm) should be designed using polymers able to be degraded in vivo. Biodegradable polyalkyl-cyanoacrylate nanoparticles that meet these requirements are contemplated for use.

E. Liposomes

The ceDNA vectors for expression of FVIII protein in accordance with the present invention can be added to liposomes for delivery to a cell or target organ in a subject. Liposomes are vesicles that possess at least one lipid bilayer. Liposomes are typical used as carriers for drug/therapeutic delivery in the context of pharmaceutical development. They work by fusing with a cellular membrane and repositioning its lipid structure to deliver a drug or active pharmaceutical ingredient (API). Liposome compositions for such delivery are composed of phospholipids, especially compounds having a phosphatidylcholine group, however these compositions may also include other lipids.

The formation and use of liposomes are generally known to those of skill in the art. Liposomes have been developed with improved serum stability and circulation half-times (U.S. Pat. No. 5,741,516). Further, various methods of liposome and liposome like preparations as potential drug carriers have been described (U.S. Pat. Nos. 5,567,434; 5,552,157; 5,565,213; 5,738,868 and 5,795,587).

F. Exemplary Liposome and Lipid Nanoparticle (LNP) Compositions

The ceDNA vectors for expression of FVIII protein in accordance with the present invention can be added to liposomes for delivery to a cell, e.g., a cell in need of expression of the transgene. Liposomes are vesicles that possess at least one lipid bilayer. Liposomes are typical used as carriers for drug/therapeutic delivery in the context of pharmaceutical development. They work by fusing with a cellular membrane and repositioning its lipid structure to deliver a drug or active pharmaceutical ingredient (API). Liposome compositions for such delivery are composed of phospholipids, especially compounds having a phosphatidylcholine group, however these compositions may also include other lipids.

Lipid nanoparticles (LNPs) comprising ceDNA vectors are disclosed in International Application PCT/US2018/050042, filed on Sep. 7, 2018, and International Application PCT/US2018/064242, filed on Dec. 6, 2018 which are incorporated herein in their entirety and envisioned for use in the methods and compositions for ceDNA vectors for expression of FVIII protein as disclosed herein.

In some aspects, the disclosure provides for a liposome formulation that includes one or more compounds with a polyethylene glycol (PEG) functional group (so-called "PEG-ylated compounds") which can reduce the immunogenicity/antigenicity of, provide hydrophilicity and hydrophobicity to the compound(s) and reduce dosage frequency. Or the liposome formulation simply includes polyethylene glycol (PEG) polymer as an additional component. In such aspects, the molecular weight of the PEG or PEG functional group can be from 62 Da to about 5,000 Da.

In some aspects, the disclosure provides for a liposome formulation that will deliver an API with extended release or controlled release profile over a period of hours to weeks. In some related aspects, the liposome formulation may comprise aqueous chambers that are bound by lipid bilayers. In other related aspects, the liposome formulation encapsulates an API with components that undergo a physical transition at elevated temperature which releases the API over a period of hours to weeks.

In some aspects, the liposome formulation comprises sphingomyelin and one or more lipids disclosed herein. In some aspects, the liposome formulation comprises optisomes.

In some aspects, the disclosure provides for a liposome formulation that includes one or more lipids selected from: N-(carbonyl-methoxypolyethylene glycol 2000)-1,2-distearoyl-sn-glycero-3-phosphoethanolamine sodium salt, (distearoyl-sn-glycero-phosphoethanolamine), MPEG (methoxy polyethylene glycol)-conjugated lipid, HSPC (hydrogenated soy phosphatidylcholine); PEG (polyethylene glycol); DSPE (distearoyl-sn-glycero-phosphoethanolamine); DSPC (distearoylphosphatidylcholine); DOPC (dioleoylphosphatidylcholine); DPPG (dipalmitoylphosphatidylglycerol); EPC (egg phosphatidylcholine); DOPS (dioleoylphosphatidylserine); POPC (palmitoyloleoylphosphatidylcholine); SM (sphingomyelin); MPEG (methoxy polyethylene glycol); DMPC (dimyristoyl phosphatidylcholine); DMPG (dimyristoyl phosphatidylglycerol); DSPG (distearoylphosphatidylglycerol); DEPC (dierucoylphosphatidylcholine); DOPE (dioleoly-sn-glycero-phophoethanolamine); cholesteryl sulphate (CS); dipalmitoylphosphatidylglycerol (DPPG); DOPC (dioleoly-sn-glycero-phosphatidylcholine) or any combination thereof.

In some aspects, the disclosure provides for a liposome formulation comprising phospholipid, cholesterol and a PEG-ylated lipid in a molar ratio of 56:38:5. In some aspects, the liposome formulation's overall lipid content is from 2-16 mg/mL. In some aspects, the disclosure provides for a liposome formulation comprising a lipid containing a phosphatidylcholine functional group, a lipid containing an ethanolamine functional group and a PEG-ylated lipid. In some aspects, the disclosure provides for a liposome formulation comprising a lipid containing a phosphatidylcholine functional group, a lipid containing an ethanolamine functional group and a PEG-ylated lipid in a molar ratio of 3:0.015:2 respectively. In some aspects, the disclosure provides for a liposome formulation comprising a lipid containing a phosphatidylcholine functional group, cholesterol and a PEG-ylated lipid. In some aspects, the disclosure provides for a liposome formulation comprising a lipid containing a phosphatidylcholine functional group and cholesterol. In some aspects, the PEG-ylated lipid is PEG-2000-DSPE. In some aspects, the disclosure provides for a liposome formulation comprising DPPG, soy PC, MPEG-DSPE lipid conjugate and cholesterol.

In some aspects, the disclosure provides for a liposome formulation comprising one or more lipids containing a phosphatidylcholine functional group and one or more lipids containing an ethanolamine functional group. In some aspects, the disclosure provides for a liposome formulation comprising one or more: lipids containing a phosphatidylcholine functional group, lipids containing an ethanolamine functional group, and sterols, e.g. cholesterol. In some aspects, the liposome formulation comprises DOPC/DEPC; and DOPE.

In some aspects, the disclosure provides for a liposome formulation further comprising one or more pharmaceutical excipients, e.g. sucrose and/or glycine.

In some aspects, the disclosure provides for a liposome formulation that is either unilamellar or multilamellar in structure. In some aspects, the disclosure provides for a liposome formulation that comprises multi-vesicular particles and/or foam-based particles. In some aspects, the disclosure provides for a liposome formulation that are larger in relative size to common nanoparticles and about 150 to 250 nm in size. In some aspects, the liposome formulation is a lyophilized powder.

In some aspects, the disclosure provides for a liposome formulation that is made and loaded with ceDNA vectors disclosed or described herein, by adding a weak base to a mixture having the isolated ceDNA outside the liposome. This addition increases the pH outside the liposomes to approximately 7.3 and drives the API into the liposome. In some aspects, the disclosure provides for a liposome formulation having a pH that is acidic on the inside of the liposome. In such cases the inside of the liposome can be at pH 4-6.9, and more preferably pH 6.5. In other aspects, the disclosure provides for a liposome formulation made by using intra-liposomal drug stabilization technology. In such cases, polymeric or non-polymeric highly charged anions and intra-liposomal trapping agents are utilized, e.g. polyphosphate or sucrose octasulfate.

In some aspects, the disclosure provides for a lipid nanoparticle comprising ceDNA and an ionizable lipid. For example, a lipid nanoparticle formulation that is made and loaded with ceDNA obtained by the process as disclosed in International Application PCT/US2018/050042, filed on Sep. 7, 2018, which is incorporated herein. This can be accomplished by high energy mixing of ethanolic lipids with aqueous ceDNA at low pH which protonates the ionizable lipid and provides favorable energetics for ceDNA/lipid association and nucleation of particles. The particles can be further stabilized through aqueous dilution and removal of the organic solvent. The particles can be concentrated to the desired level.

Generally, the lipid particles are prepared at a total lipid to ceDNA (mass or weight) ratio of from about 10:1 to 30:1. In some embodiments, the lipid to ceDNA ratio (mass/mass ratio; w/w ratio) can be in the range of from about 1:1 to about 25:1, from about 10:1 to about 14:1, from about 3:1 to about 15:1, from about 4:1 to about 10:1, from about 5:1 to about 9:1, or about 6:1 to about 9:1. The amounts of lipids and ceDNA can be adjusted to provide a desired N/P ratio, for example, N/P ratio of 3, 4, 5, 6, 7, 8, 9, 10 or higher. Generally, the lipid particle formulation's overall lipid content can range from about 5 mg/ml to about 30 mg/mL.

The ionizable lipid is typically employed to condense the nucleic acid cargo, e.g., ceDNA at low pH and to drive membrane association and fusogenicity. Generally, ionizable lipids are lipids comprising at least one amino group that is positively charged or becomes protonated under acidic conditions, for example at pH of 6.5 or lower. Ionizable lipids are also referred to as cationic lipids herein.

Exemplary ionizable lipids are described in International PCT patent publications WO2015/095340, WO2015/199952, WO2018/011633, WO2017/049245, WO2015/061467, WO2012/040184, WO2012/000104, WO2015/074085, WO2016/081029, WO2017/004143, WO2017/075531, WO2017/117528, WO2011/022460, WO2013/148541, WO2013/116126, WO2011/153120, WO2012/044638, WO2012/054365, WO2011/090965, WO2013/016058, WO2012/162210, WO2008/042973, WO2010/129709, WO2010/144740, WO2012/099755, WO2013/049328, WO2013/086322, WO2013/086373, WO2011/071860, WO2009/132131, WO2010/048536, WO2010/088537, WO2010/054401, WO2010/054406, WO2010/054405, WO2010/054384, WO2012/016184, WO2009/086558, WO2010/042877, WO2011/000106, WO2011/000107, WO2005/120152, WO2011/141705, WO2013/126803, WO2006/007712, WO2011/038160, WO2005/121348, WO2011/066651, WO2009/127060, WO2011/141704, WO2006/069782, WO2012/031043, WO2013/006825, WO2013/033563, WO2013/089151, WO2017/099823, WO2015/095346, and WO2013/086354, and US patent publications 052016/0311759, 052015/0376115, 052016/0151284, 052017/0210697, 052015/0140070, 052013/0178541, 052013/0303587, 052015/0141678, 052015/0239926, 052016/0376224, 052017/0119904, 052012/0149894, 052015/0057373, 052013/0090372, 052013/0274523, US2013/0274504, US2013/0274504, 052009/0023673, US2012/0128760, US2010/0324120, 052014/0200257, 052015/0203446, 052018/0005363, 052014/0308304, 052013/0338210, 052012/0101148, 052012/0027796, 052012/0058144, 052013/0323269, 052011/0117125, 052011/0256175, 052012/0202871, 052011/0076335, 052006/0083780, 052013/0123338, 052015/0064242, 052006/0051405, US2013/0065939, 052006/0008910, 052003/0022649, 052010/0130588, 052013/0116307, 052010/0062967, 052013/0202684, 052014/0141070, 052014/0255472, 052014/0039032, 052018/0028664, 052016/0317458, and 052013/0195920, the contents of all of which are incorporated herein by reference in their entirety.

In some embodiments, the ionizable lipid is MC3 (6Z, 9Z,28Z,31Z)-heptatriaconta-6,9,28,31-tetraen-19-yl-4-(dimethylamino) butanoate (DLin-MC3-DMA or MC3) having the following structure:

The lipid DLin-MC3-DMA is described in Jayaraman et al., Angew. Chem. Int. Ed Engl. (2012), 51(34): 8529-8533, content of which is incorporated herein by reference in its entirety.

In some embodiments, the ionizable lipid is the lipid ATX-002 as described in WO2015/074085, content of which is incorporated herein by reference in its entirety.

In some embodiments, the ionizable lipid is (13Z,16Z)—N,N-dimethyl-3-nonyldocosa-13,16-dien-1-amine (Compound 32), as described in WO2012/040184, content of which is incorporated herein by reference in its entirety.

In some embodiments, the ionizable lipid is Compound 6 or Compound 22 as described in WO2015/199952, content of which is incorporated herein by reference in its entirety.

Without limitations, ionizable lipid can comprise 20-90% (mol) of the total lipid present in the lipid nanoparticle. For example, ionizable lipid molar content can be 20-70% (mol), 30-60% (mol) or 40-50% (mol) of the total lipid present in the lipid nanoparticle. In some embodiments, ionizable lipid comprises from about 50 mol % to about 90 mol % of the total lipid present in the lipid nanoparticle.

In some aspects, the lipid nanoparticle can further comprise a non-cationic lipid. Non-ionic lipids include amphipathic lipids, neutral lipids and anionic lipids. Accordingly, the non-cationic lipid can be a neutral uncharged, zwitterionic, or anionic lipid. Non-cationic lipids are typically employed to enhance fusogenicity.

Exemplary non-cationic lipids envisioned for use in the methods and compositions as disclosed herein are described in International Application PCT/US2018/050042, filed on Sep. 7, 2018, and PCT/US2018/064242, filed on Dec. 6, 2018 which is incorporated herein in its entirety. Exemplary non-cationic lipids are described in International Application Publication WO2017/099823 and US patent publication US2018/0028664, the contents of both of which are incorporated herein by reference in their entirety.

The non-cationic lipid can comprise 0-30% (mol) of the total lipid present in the lipid nanoparticle. For example, the non-cationic lipid content is 5-20% (mol) or 10-15% (mol) of the total lipid present in the lipid nanoparticle. In various embodiments, the molar ratio of ionizable lipid to the neutral lipid ranges from about 2:1 to about 8:1.

In some embodiments, the lipid nanoparticles do not comprise any phospholipids. In some aspects, the lipid nanoparticle can further comprise a component, such as a sterol, to provide membrane integrity.

One exemplary sterol that can be used in the lipid nanoparticle is cholesterol and derivatives thereof. Exemplary cholesterol derivatives are described in International application WO2009/127060 and US patent publication US2010/0130588, contents of both of which are incorporated herein by reference in their entirety.

The component providing membrane integrity, such as a sterol, can comprise 0-50% (mol) of the total lipid present in the lipid nanoparticle. In some embodiments, such a component is 20-50% (mol) 30-40% (mol) of the total lipid content of the lipid nanoparticle.

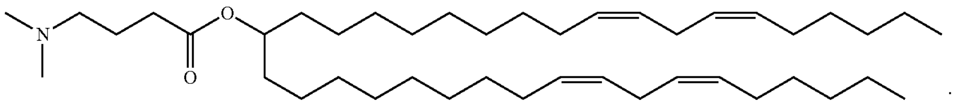

DLin-M-C3-DMA ("MC3")

In some aspects, the lipid nanoparticle can further comprise a polyethylene glycol (PEG) or a conjugated lipid molecule. Generally, these are used to inhibit aggregation of lipid nanoparticles and/or provide steric stabilization. Exemplary conjugated lipids include, but are not limited to, PEG-lipid conjugates, polyoxazoline (POZ)-lipid conjugates, polyamide-lipid conjugates (such as ATTA-lipid conjugates), cationic-polymer lipid (CPL) conjugates, and mixtures thereof. In some embodiments, the conjugated lipid molecule is a PEG-lipid conjugate, for example, a (methoxy polyethylene glycol)-conjugated lipid. Exemplary PEG-lipid conjugates include, but are not limited to, PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), PEG succinate diacylglycerol (PEGS-DAG) (such as 4-O-(2',3'-di(tetradecanoyloxy)propyl-1-O-(w-methoxy(polyethoxy)ethyl) butanedioate (PEG-S-DMG)), PEG dialkoxypropylcarbam, N-(carbonyl-methoxypolyethylene glycol 2000)-1,2-distearoyl-sn-glycero-3-phosphoethanolamine sodium salt, or a mixture thereof. Additional exemplary PEG-lipid conjugates are described, for example, in U.S. Pat. Nos. 5,885,613, 6,287,591, US2003/0077829, US2003/0077829, US2005/0175682, US2008/0020058, US2011/0117125, US2010/0130588, US2016/0376224, and US2017/0119904, the contents of all of which are incorporated herein by reference in their entirety.

In some embodiments, a PEG-lipid is a compound as defined in US2018/0028664, the content of which is incorporated herein by reference in its entirety. In some embodiments, a PEG-lipid is disclosed in US20150376115 or in US2016/0376224, the content of both of which is incorporated herein by reference in its entirety.

The PEG-DAA conjugate can be, for example, PEG-dilauryloxypropyl, PEG-dimyristyloxypropyl, PEG-dipalmityloxypropyl, or PEG-distearyloxypropyl. The PEG-lipid can be one or more of PEG-DMG, PEG-dilaurylglycerol, PEG-dipalmitoylglycerol, PEG-disterylglycerol, PEG-dilaurylglycamide, PEG-dimyristylglycamide, PEG-dipalmitoylglycamide, PEG-disterylglycamide, PEG-cholesterol (1-[8'-(Cholest-5-en-3 [beta]-oxy)carboxamido-3',6'-dioxaoctanyl] carbamoyl-[omega]-methyl-poly(ethylene glycol), PEG-DMB (3,4-Ditetradecoxylbenzyl-[omega]-methyl-poly(ethylene glycol) ether), and 1,2-dimyristoyl-sn-glycero-3-phosphoethanolamine-N-[methoxy(polyethylene glycol)-2000]. In some examples, the PEG-lipid can be selected from the group consisting of PEG-DMG, 1,2-dimyristoyl-sn-glycero-3-phosphoethanolamine-N-[methoxy(polyethylene glycol)-2000], Lipids conjugated with a molecule other than a PEG can also be used in place of PEG-lipid. For example, polyoxazoline (POZ)-lipid conjugates, polyamide-lipid conjugates (such as ATTA-lipid conjugates), and cationic-polymer lipid (CPL) conjugates can be used in place of or in addition to the PEG-lipid. Exemplary conjugated lipids, i.e., PEG-lipids, (POZ)-lipid conjugates, ATTA-lipid conjugates and cationic polymer-lipids are described in the International patent application publications WO1996/010392, WO1998/051278, WO2002/087541, WO2005/026372, WO2008/147438, WO2009/086558, WO2012/000104, WO2017/117528, WO2017/099823, WO2015/199952, WO2017/004143, WO2015/095346, WO2012/000104, WO2012/000104, and WO2010/006282, US patent application publications US2003/0077829, US2005/0175682, US2008/0020058, US2011/0117125, US2013/0303587, US2018/0028664, US2015/0376115, US2016/0376224, US2016/0317458, US2013/0303587, US2013/0303587, and US20110123453, and US patents U.S. Pat. Nos. 5,885,613, 6,287,591, 6,320,017, and 6,586,559, the contents of all of which are incorporated herein by reference in their entirety.

In some embodiments, the one or more additional compound can be a therapeutic agent. The therapeutic agent can be selected from any class suitable for the therapeutic objective. In other words, the therapeutic agent can be selected from any class suitable for the therapeutic objective. In other words, the therapeutic agent can be selected according to the treatment objective and biological action desired. For example, if the ceDNA within the LNP is useful for treating hemophilia A, the additional compound can be an anti-hemophilia A agent (e.g., a chemotherapeutic agent, or other hemophilia A therapy (including, but not limited to, a small molecule or an antibody). In another example, if the LNP containing the ceDNA is useful for treating an infection, the additional compound can be an antimicrobial agent (e.g., an antibiotic or antiviral compound). In yet another example, if the LNP containing the ceDNA is useful for treating an immune disease or disorder, the additional compound can be a compound that modulates an immune response (e.g., an immunosuppressant, immunostimulatory compound, or compound modulating one or more specific immune pathways). In some embodiments, different cocktails of different lipid nanoparticles containing different compounds, such as a ceDNA encoding a different protein or a different compound, such as a therapeutic may be used in the compositions and methods of the invention.

In some embodiments, the additional compound is an immune modulating agent. For example, the additional compound is an immunosuppressant. In some embodiments, the additional compound is immune stimulatory agent. Also provided herein is a pharmaceutical composition comprising the lipid nanoparticle-encapsulated insect-cell produced, or a synthetically produced ceDNA vector for expression of FVIII protein as described herein and a pharmaceutically acceptable carrier or excipient.

In some aspects, the disclosure provides for a lipid nanoparticle formulation further comprising one or more pharmaceutical excipients. In some embodiments, the lipid nanoparticle formulation further comprises sucrose, tris, trehalose and/or glycine.

The ceDNA vector can be complexed with the lipid portion of the particle or encapsulated in the lipid position of the lipid nanoparticle. In some embodiments, the ceDNA can be fully encapsulated in the lipid position of the lipid nanoparticle, thereby protecting it from degradation by a nuclease, e.g., in an aqueous solution. In some embodiments, the ceDNA in the lipid nanoparticle is not substantially degraded after exposure of the lipid nanoparticle to a nuclease at 37° C. for at least about 20, 30, 45, or 60 minutes. In some embodiments, the ceDNA in the lipid nanoparticle is not substantially degraded after incubation of the particle in serum at 37° C. for at least about 30, 45, or 60 minutes or at least about 2, 3, 4, 5, 6, 7, 8, 9, 10, 12, 14, 16, 18, 20, 22, 24, 26, 28, 30, 32, 34, or 36 hours.

In certain embodiments, the lipid nanoparticles are substantially non-toxic to a subject, e.g., to a mammal such as a human. In some aspects, the lipid nanoparticle formulation is a lyophilized powder.

In some embodiments, lipid nanoparticles are solid core particles that possess at least one lipid bilayer. In other embodiments, the lipid nanoparticles have a non-bilayer structure, i.e., a non-lamellar (i.e., non-bilayer) morphology. Without limitations, the non-bilayer morphology can include, for example, three dimensional tubes, rods, cubic symmetries, etc. For example, the morphology of the lipid nanoparticles (lamellar vs. non-lamellar) can readily be assessed and characterized using, e.g., Cryo-TEM analysis as described in US2010/0130588, the content of which is incorporated herein by reference in its entirety.

In some further embodiments, the lipid nanoparticles having a non-lamellar morphology are electron dense. In some aspects, the disclosure provides for a lipid nanoparticle that is either unilamellar or multilamellar in structure. In some aspects, the disclosure provides for a lipid nanoparticle formulation that comprises multi-vesicular particles and/or foam-based particles.

By controlling the composition and concentration of the lipid components, one can control the rate at which the lipid conjugate exchanges out of the lipid particle and, in turn, the rate at which the lipid nanoparticle becomes fusogenic. In addition, other variables including, e.g., pH, temperature, or ionic strength, can be used to vary and/or control the rate at which the lipid nanoparticle becomes fusogenic. Other methods which can be used to control the rate at which the lipid nanoparticle becomes fusogenic will be apparent to those of ordinary skill in the art based on this disclosure. It will also be apparent that by controlling the composition and concentration of the lipid conjugate, one can control the lipid particle size.

The pKa of formulated cationic lipids can be correlated with the effectiveness of the LNPs for delivery of nucleic acids (see Jayaraman et al., Angewandte Chemie, International Edition (2012), 51(34), 8529-8533; Semple et al., Nature Biotechnology 28, 172-176 (2010), both of which are incorporated by reference in their entirety). The preferred range of pKa is ~5 to ~7. The pKa of the cationic lipid can be determined in lipid nanoparticles using an assay based on fluorescence of 2-(p-toluidino)-6-napthalene sulfonic acid (TNS).

VIII. Methods of Use

A ceDNA vector for expression of FVIII protein as disclosed herein can also be used in a method for the delivery of a nucleotide sequence of interest (e.g., encoding FVIII protein) to a target cell (e.g., a host cell). The method may in particular be a method for delivering FVIII protein to a cell of a subject in need thereof and treating hemophilia A. The invention allows for the in vivo expression of FVIII protein encoded in the ceDNA vector in a cell in a subject such that therapeutic effect of the expression of FVIII protein occurs. These results are seen with both in vivo and in vitro modes of ceDNA vector delivery.

In addition, the invention provides a method for the delivery of FVIII protein in a cell of a subject in need thereof, comprising multiple administrations of the ceDNA vector of the invention encoding said FVIII protein. Since the ceDNA vector of the invention does not induce an immune response like that typically observed against encapsidated viral vectors, such a multiple administration strategy will likely have greater success in a ceDNA-based system. The ceDNA vector are administered in sufficient amounts to transfect the cells of a desired tissue and to provide sufficient levels of gene transfer and expression of the FVIII protein without undue adverse effects. Conventional and pharmaceutically acceptable routes of administration include, but are not limited to, retinal administration (e.g., subretinal injection, suprachoroidal injection or intravitreal injection), intravenous (e.g., in a liposome formulation), direct delivery to the selected organ (e.g., any one or more tissues selected from: liver, kidneys, gallbladder, prostate, adrenal gland, heart, intestine, lung, and stomach), intramuscular, and other parental routes of administration. Routes of administration may be combined, if desired.

Delivery of a ceDNA vector for expression of FVIII protein as described herein is not limited to delivery of the expressed FVIII protein. For example, conventionally produced (e.g., using a cell-based production method (e.g., insect-cell production methods) or synthetically produced ceDNA vectors as described herein may be used with other delivery systems provided to provide a portion of the gene therapy. One non-limiting example of a system that may be combined with the ceDNA vectors in accordance with the present disclosure includes systems which separately deliver one or more co-factors or immune suppressors for effective gene expression of the ceDNA vector expressing the FVIII protein.

The invention also provides for a method of treating hemophilia A in a subject comprising introducing into a target cell in need thereof (in particular a muscle cell or tissue) of the subject a therapeutically effective amount of a ceDNA vector, optionally with a pharmaceutically acceptable carrier. While the ceDNA vector can be introduced in the presence of a carrier, such a carrier is not required. The ceDNA vector selected comprises a nucleotide sequence encoding an FVIII protein useful for treating hemophilia A. In particular, the ceDNA vector may comprise a desired FVIII protein sequence operably linked to control elements capable of directing transcription of the desired FVIII protein encoded by the exogenous DNA sequence when introduced into the subject. The ceDNA vector can be administered via any suitable route as provided above, and elsewhere herein.

The compositions and vectors provided herein can be used to deliver an FVIII protein for various purposes. In some embodiments, the transgene encodes an FVIII protein that is intended to be used for research purposes, e.g., to create a somatic transgenic animal model harboring the transgene, e.g., to study the function of the FVIII protein product. In another example, the transgene encodes an FVIII protein that is intended to be used to create an animal model of hemophilia A. In some embodiments, the encoded FVIII protein is useful for the treatment or prevention of hemophilia A states in a mammalian subject. The FVIII protein can be transferred (e.g., expressed in) to a patient in a sufficient amount to treat hemophilia A associated with reduced expression, lack of expression or dysfunction of the gene.

In principle, the expression cassette can include a nucleic acid or any transgene that encodes an FVIII protein that is either reduced or absent due to a mutation or which conveys a therapeutic benefit when overexpressed is considered to be within the scope of the invention. Preferably, noninserted bacterial DNA is not present and preferably no bacterial DNA is present in the ceDNA compositions provided herein.

A ceDNA vector is not limited to one species of ceDNA vector. As such, in another aspect, multiple ceDNA vectors expressing different proteins or the same FVIII protein but operatively linked to different promoters or cis-regulatory elements can be delivered simultaneously or sequentially to the target cell, tissue, organ, or subject. Therefore, this strategy can allow for the gene therapy or gene delivery of multiple proteins simultaneously. It is also possible to separate different portions of a FVIII protein into separate ceDNA vectors (e.g., different domains and/or co-factors required for functionality of a FVIII protein) which can be administered simultaneously or at different times, and can be separately regulatable, thereby adding an additional level of control of expression of a FVIII protein. Delivery can also be performed multiple times and, importantly for gene therapy in the clinical setting, in subsequent increasing or decreasing doses, given the lack of an anti-capsid host immune response due to the absence of a viral capsid. It is anticipated that no anti-capsid response will occur as there is no capsid.

The invention also provides for a method of treating hemophilia A in a subject comprising introducing into a target cell in need thereof (in particular a muscle cell or tissue) of the subject a therapeutically effective amount of a ceDNA vector as disclosed herein, optionally with a pharmaceutically acceptable carrier. While the ceDNA vector can be introduced in the presence of a carrier, such a carrier is not required. The ceDNA vector implemented comprises a nucleotide sequence of interest useful for treating the hemophilia A. In particular, the ceDNA vector may comprise a desired exogenous DNA sequence operably linked to control elements capable of directing transcription of the desired polypeptide, protein, or oligonucleotide encoded by the exogenous DNA sequence when introduced into the subject. The ceDNA vector can be administered via any suitable route as provided above, and elsewhere herein.

IX. Methods of Delivering ceDNA Vectors for FVIII Protein Production

In some embodiments, a ceDNA vector for expression of FVIII protein can be delivered to a target cell in vitro or in vivo by various suitable methods. ceDNA vectors alone can be applied or injected. CeDNA vectors can be delivered to a cell without the help of a transfection reagent or other physical means. Alternatively, ceDNA vectors for expression of FVIII protein can be delivered using any art-known transfection reagent or other art-known physical means that facilitates entry of DNA into a cell, e.g., liposomes, alcohols, polylysine-rich compounds, arginine-rich compounds, calcium phosphate, microvesicles, microinjection, electroporation and the like.

The ceDNA vectors for expression of FVIII protein as disclosed herein can efficiently target cell and tissue-types that are normally difficult to transduce with conventional AAV virions using various delivery reagent.

One aspect of the technology described herein relates to a method of delivering an FVIII protein to a cell. Typically, for in vivo and in vitro methods, a ceDNA vector for expression of FVIII protein as disclosed herein may be introduced into the cell using the methods as disclosed herein, as well as other methods known in the art. A ceDNA vector for expression of FVIII protein as disclosed herein are preferably administered to the cell in a biologically-effective amount. If the ceDNA vector is administered to a cell in vivo (e.g., to a subject), a biologically-effective amount of the ceDNA vector is an amount that is sufficient to result in transduction and expression of the FVIII protein in a target cell.

Exemplary modes of administration of a ceDNA vector for expression of FVIII protein as disclosed herein includes oral, rectal, transmucosal, intranasal, inhalation (e.g., via an aerosol), buccal (e.g., sublingual), vaginal, intrathecal, intraocular, transdermal, intraendothelial, in utero (or in ovo), parenteral (e.g., intravenous, subcutaneous, intradermal, intracranial, intramuscular [including administration to skeletal, diaphragm and/or cardiac muscle], intrapleural, intracerebral, and intraarticular). Administration can be systemically or direct delivery to the liver or elsewhere (e.g., any kidneys, gallbladder, prostate, adrenal gland, heart, intestine, lung, and stomach).

Administration can be topical (e.g., to both skin and mucosal surfaces, including airway surfaces, and transdermal administration), intralymphatic, and the like, as well as direct tissue or organ injection (e.g., but not limited to, liver, but also to eye, muscles, including skeletal muscle, cardiac muscle, diaphragm muscle, or brain).

Administration of the ceDNA vector can be to any site in a subject, including, without limitation, a site selected from the group consisting of the liver and/or also eyes, brain, a skeletal muscle, a smooth muscle, the heart, the diaphragm, the airway epithelium, the kidney, the spleen, the pancreas, the skin.

The most suitable route in any given case will depend on the nature and severity of the condition being treated, ameliorated, and/or prevented and on the nature of the particular ceDNA vector that is being used. Additionally, ceDNA permits one to administer more than one FVIII protein in a single vector, or multiple ceDNA vectors (e.g. a ceDNA cocktail).

A. Intramuscular Administration of a ceDNA Vector

In some embodiments, a method of treating a disease in a subject comprises introducing into a target cell in need thereof (in particular a muscle cell or tissue) of the subject a therapeutically effective amount of a ceDNA vector encoding an FVIII protein, optionally with a pharmaceutically acceptable carrier. In some embodiments, the ceDNA vector for expression of FVIII protein is administered to a muscle tissue of a subject.

In some embodiments, administration of the ceDNA vector can be to any site in a subject, including, without limitation, a site selected from the group consisting of a skeletal muscle, a smooth muscle, the heart, the diaphragm, or muscles of the eye.

Administration of a ceDNA vector for expression of FVIII protein as disclosed herein to a skeletal muscle according to the present invention includes but is not limited to administration to the skeletal muscle in the limbs (e.g., upper arm, lower arm, upper leg, and/or lower leg), back, neck, head (e.g., tongue), thorax, abdomen, pelvis/perineum, and/or digits. The ceDNA as disclosed herein vector can be delivered to skeletal muscle by intravenous administration, intra-arterial administration, intraperitoneal administration, limb perfusion, (optionally, isolated limb perfusion of a leg and/or arm; see, e.g. Arruda et al., (2005) Blood 105: 3458-3464), and/or direct intramuscular injection. In particular embodiments, the ceDNA vector as disclosed herein is administered to the liver, eye, a limb (arm and/or leg) of a subject (e.g., a subject with muscular dystrophy such as DMD) by limb perfusion, optionally isolated limb perfusion (e.g., by intravenous or intra-articular administration. In embodiments, the ceDNA vector as disclosed herein can be administered without employing "hydrodynamic" techniques.

For instance, tissue delivery (e.g., to retina) of conventional viral vectors is often enhanced by hydrodynamic techniques (e.g., intravenous/intravenous administration in a large volume), which increase pressure in the vasculature and facilitate the ability of the viral vector to cross the endothelial cell barrier. In particular embodiments, the ceDNA vectors described herein can be administered in the absence of hydrodynamic techniques such as high volume infusions and/or elevated intravascular pressure (e.g., greater than normal systolic pressure, for example, less than or equal to a 5%, 10%, 15%, 20%, 25% increase in intravascular pressure over normal systolic pressure). Such methods may reduce or avoid the side effects associated with hydrodynamic techniques such as edema, nerve damage and/or compartment syndrome.

Furthermore, a composition comprising a ceDNA vector for expression of FVIII protein as disclosed herein that is administered to a skeletal muscle can be administered to a skeletal muscle in the limbs (e.g., upper arm, lower arm, upper leg, and/or lower leg), back, neck, head (e.g., tongue), thorax, abdomen, pelvis/perineum, and/or digits. Suitable skeletal muscles include but are not limited to abductor digiti minimi (in the hand), abductor digiti minimi (in the foot), abductor hallucis, abductor ossis metatarsi quinti, abductor pollicis brevis, abductor pollicis longus, adductor brevis, adductor hallucis, adductor longus, adductor magnus, adductor pollicis, anconeus, anterior scalene, articularis genus, biceps brachii, biceps femoris, brachialis, brachioradialis, buccinator, coracobrachialis, corrugator supercilii, deltoid, depressor anguli oris, depressor labii inferioris, digastric, dorsal interossei (in the hand), dorsal interossei (in the foot), extensor carpi radialis brevis, extensor carpi radialis longus, extensor carpi ulnaris, extensor digiti minimi, extensor digitorum, extensor digitorum brevis, extensor digitorum longus, extensor hallucis brevis, extensor hallucis longus, extensor indicis, extensor pollicis brevis, extensor pollicis longus, flexor carpi radialis, flexor carpi ulnaris, flexor digiti minimi brevis (in the hand), flexor digiti minimi brevis (in the foot), flexor digitorum brevis, flexor digitorum longus, flexor digitorum profundus, flexor digitorum superficialis, flexor hallucis brevis, flexor hallucis longus, flexor pollicis brevis, flexor pollicis longus, frontalis, gastrocnemius, geniohyoid, gluteus maximus, gluteus medius, gluteus minimus, gracilis, iliocostalis cervicis, iliocostalis lumborum, iliocostalis thoracis, illiacus, inferior gemellus, inferior oblique, inferior rectus, infraspinatus, interspinalis, intertransversi, lateral pterygoid, lateral rectus, latissimus dorsi, levator anguli oris, levator labii superioris, levator labii superioris alaeque nasi, levator palpebrae superioris, levator scapulae, long rotators, longissimus capitis, longissimus cervicis, longissimus thoracis, longus capitis, longus colli, lumbricals (in the hand), lumbricals (in the foot), masseter, medial pterygoid, medial rectus, middle scalene, multifidus, mylohyoid, obliquus capitis inferior, obliquus capitis superior, obturator externus, obturator internus, occipitalis, omohyoid, opponens digiti minimi, opponens pollicis, orbicularis oculi, orbicularis oris, palmar interossei, palmaris brevis, palmaris longus, pectineus, pectoralis major, pectoralis minor, peroneus brevis, peroneus longus, peroneus tertius, piriformis, plantar interossei, plantaris, platysma, popliteus, posterior scalene, pronator quadratus, pronator teres, psoas major, quadratus femoris, quadratus plantae, rectus capitis anterior, rectus capitis lateralis, rectus capitis posterior major, rectus capitis posterior minor, rectus femoris, rhomboid major, rhomboid minor, risorius, sartorius, scalenus minimus, semimembranosus, semispinalis capitis, semispinalis cervicis, semispinalis thoracis, semitendinosus, serratus anterior, short rotators, soleus, spinalis capitis, spinalis cervicis, spinalis thoracis, splenius capitis, splenius cervicis, sternocleidomastoid, sternohyoid, sternothyroid, stylohyoid, subclavius, subscapularis, superior gemellus, superior oblique, superior rectus, supinator, supraspinatus, temporalis, tensor fascia lata, teres major, teres minor, thoracis, thyrohyoid, tibialis anterior, tibialis posterior, trapezius, triceps brachii, vastus intermedius, vastus lateralis, vastus medialis, zygomaticus major, and zygomaticus minor, and any other suitable skeletal muscle as known in the art.

Administration of a ceDNA vector for expression of FVIII protein as disclosed herein to diaphragm muscle can be by any suitable method including intravenous administration, intra-arterial administration, and/or intra-peritoneal administration. In some embodiments, delivery of an expressed transgene from the ceDNA vector to a target tissue can also be achieved by delivering a synthetic depot comprising the ceDNA vector, where a depot comprising the ceDNA vector is implanted into skeletal, smooth, cardiac and/or diaphragm muscle tissue or the muscle tissue can be contacted with a film or other matrix comprising the ceDNA vector as described herein. Such implantable matrices or substrates are described in U.S. Pat. No. 7,201,898.

Administration of a ceDNA vector for expression of FVIII protein as disclosed herein to cardiac muscle includes administration to the left atrium, right atrium, left ventricle, right ventricle and/or septum. The ceDNA vector as described herein can be delivered to cardiac muscle by intravenous administration, intra-arterial administration such as intra-aortic administration, direct cardiac injection (e.g., into left atrium, right atrium, left ventricle, right ventricle), and/or coronary artery perfusion.

Administration of a ceDNA vector for expression of FVIII protein as disclosed herein to smooth muscle can be by any suitable method including intravenous administration, intra-arterial administration, and/or intra-peritoneal administration. In one embodiment, administration can be to endothelial cells present in, near, and/or on smooth muscle. Non-limiting examples of smooth muscles include the iris of the eye, bronchioles of the lung, laryngeal muscles (vocal cords), muscular layers of the stomach, esophagus, small and large intestine of the gastrointestinal tract, ureter, detrusor muscle of the urinary bladder, uterine myometrium, penis, or prostate gland.

In some embodiments, of a ceDNA vector for expression of FVIII protein as disclosed herein is administered to skeletal muscle, diaphragm muscle and/or cardiac muscle. In representative embodiments, a ceDNA vector according to the present invention is used to treat and/or prevent disorders of skeletal, cardiac and/or diaphragm muscle.

Specifically, it is contemplated that a composition comprising a ceDNA vector for expression of FVIII protein as disclosed herein can be delivered to one or more muscles of the eye (e.g., Lateral rectus, Medial rectus, Superior rectus, Inferior rectus, Superior oblique, Inferior oblique), facial muscles (e.g., Occipitofrontalis muscle, Temporoparietalis muscle, Procerus muscle, Nasalis muscle, Depressor septi nasi muscle, Orbicularis oculi muscle, Corrugator supercilii muscle, Depressor supercilii muscle, Auricular muscles, Orbicularis oris muscle, Depressor anguli oris muscle, Risorius, Zygomaticus major muscle, Zygomaticus minor muscle, Levator labii superioris, Levator labii superioris alaeque nasi muscle, Depressor labii inferioris muscle, Levator anguli oris, Buccinator muscle, Mentalis) or tongue muscles (e.g., genioglossus, hyoglossus, chondroglossus, styloglossus, palatoglossus, superior longitudinal muscle, inferior longitudinal muscle, the vertical muscle, and the transverse muscle).

(i) Intramuscular Injection:

In some embodiments, a composition comprising a ceDNA vector for expression of FVIII protein as disclosed herein can be injected into one or more sites of a given muscle, for example, skeletal muscle (e.g., deltoid, vastus lateralis, ventrogluteal muscle of dorsogluteal muscle, or anterolateral thigh for infants) in a subject using a needle. The composition comprising ceDNA can be introduced to other subtypes of muscle cells. Non-limiting examples of muscle cell subtypes include skeletal muscle cells, cardiac muscle cells, smooth muscle cells and/or diaphragm muscle cells.

Methods for intramuscular injection are known to those of skill in the art and as such are not described in detail herein. However, when performing an intramuscular injection, an appropriate needle size should be determined based on the age and size of the patient, the viscosity of the composition, as well as the site of injection. Table 8 provides guidelines for exemplary sites of injection and corresponding needle size:

TABLE 8

Guidelines for intramuscular injection in human patients

| Injection Site | Needle Gauge | Needle Size | Maximum volume of composition |
|---|---|---|---|
| Ventrogluteal site (gluteus medius and gluteus minimus) | Aqueous solutions: 20-25 gauge Viscous or oil-based solution: 18-21 gauge | Thin adult: 15 to 25 mm Average adult: 25 mm Larger adult (over 150 lbs): 25 to 38 mm. Children and infants: will require a smaller needle | 3 mL |
| Vastus lateralis | Aqueous solutions: 20-25 gauge Viscous or oil-based solution: 18-21 gauge Children/infants: 22 to 25 gauge | Adult: 25 mm to 38 mm | 3 mL |
| Deltoid | 22 to 25 gauge | Males: 130-2601bs: 25 mm Females: <130 lbs: 16 mm 130-200 lbs: 25 mm >2001bs: 38 mm | 1 mL |

In certain embodiments, a ceDNA vector for expression of FVIII protein as disclosed herein is formulated in a small volume, for example, an exemplary volume as outlined in Table 8 for a given subject. In some embodiments, the subject can be administered a general or local anesthetic prior to the injection, if desired. This is particularly desirable if multiple injections are required or if a deeper muscle is injected, rather than the common injection sites noted above.

In some embodiments, intramuscular injection can be combined with electroporation, delivery pressure or the use of transfection reagents to enhance cellular uptake of the ceDNA vector.

(ii) Transfection Reagents:

In some embodiments, a ceDNA vector for expression of FVIII protein as disclosed herein is formulated in compositions comprising one or more transfection reagents to facilitate uptake of the vectors into myotubes or muscle tissue. Thus, in one embodiment, the nucleic acids described herein are administered to a muscle cell, myotube or muscle tissue by transfection using methods described elsewhere herein.

(iii) Electroporation:

In certain embodiments, a ceDNA vector for expression of FVIII protein as disclosed herein is administered in the absence of a carrier to facilitate entry of ceDNA into the cells, or in a physiologically inert pharmaceutically acceptable carrier (i.e., any carrier that does not improve or enhance uptake of the capsid free, non-viral vectors into the myotubes). In such embodiments, the uptake of the capsid free, non-viral vector can be facilitated by electroporation of the cell or tissue.

Cell membranes naturally resist the passage of extracellular into the cell cytoplasm. One method for temporarily reducing this resistance is "electroporation", where electrical fields are used to create pores in cells without causing permanent damage to the cells. These pores are large enough to allow DNA vectors, pharmaceutical drugs, DNA, and other polar compounds to gain access to the interior of the cell. With time, the pores in the cell membrane close and the cell once again becomes impermeable.

Electroporation can be used in both in vitro and in vivo applications to introduce e.g., exogenous DNA into living cells. In vitro applications typically mix a sample of live cells with the composition comprising e.g., DNA. The cells are then placed between electrodes such as parallel plates and an electrical field is applied to the cell/composition mixture.

There are a number of methods for in vivo electroporation; electrodes can be provided in various configurations such as, for example, a caliper that grips the epidermis overlying a region of cells to be treated. Alternatively, needle-shaped electrodes may be inserted into the tissue, to access more deeply located cells. In either case, after the composition comprising e.g., nucleic acids are injected into the treatment region, the electrodes apply an electrical field to the region. In some electroporation applications, this electric field comprises a single square wave pulse on the order of 100 to 500 V/cm. of about 10 to 60 ms duration. Such a pulse may be generated, for example, in known applications of the Electro Square Porator T820, made by the BTX Division of Genetronics, Inc.

Typically, successful uptake of e.g., nucleic acids occurs only if the muscle is electrically stimulated immediately, or shortly after administration of the composition, for example, by injection into the muscle.

In certain embodiments, electroporation is achieved using pulses of electric fields or using low voltage/long pulse treatment regimens (e.g., using a square wave pulse electroporation system). Exemplary pulse generators capable of generating a pulsed electric field include, for example, the ECM600, which can generate an exponential wave form, and the ElectroSquarePorator (T820), which can generate a square wave form, both of which are available from BTX, a division of Genetronics, Inc. (San Diego, Calif.). Square wave electroporation systems deliver controlled electric pulses that rise quickly to a set voltage, stay at that level for a set length of time (pulse length), and then quickly drop to zero.

In some embodiments, a local anesthetic is administered, for example, by injection at the site of treatment to reduce pain that may be associated with electroporation of the tissue in the presence of a composition comprising a capsid free, non-viral vector as described herein. In addition, one of skill in the art will appreciate that a dose of the composition should be chosen that minimizes and/or prevents excessive tissue damage resulting in fibrosis, necrosis or inflammation of the muscle.

(iv) Delivery Pressure:

In some embodiments, delivery of a ceDNA vector for expression of FVIII protein as disclosed herein to muscle tissue is facilitated by delivery pressure, which uses a combination of large volumes and rapid injection into an artery supplying a limb (e.g., iliac artery). This mode of administration can be achieved through a variety of methods that involve infusing limb vasculature with a composition comprising a ceDNA vector, typically while the muscle is isolated from the systemic circulation using a tourniquet of vessel clamps. In one method, the composition is circulated through the limb vasculature to permit extravasation into the cells. In another method, the intravascular hydrodynamic pressure is increased to expand vascular beds and increase uptake of the ceDNA vector into the muscle cells or tissue. In one embodiment, the ceDNA composition is administered into an artery.

(v) Lipid Nanoparticle Compositions:

In some embodiments, a ceDNA vector for expression of FVIII protein as disclosed herein for intramuscular delivery are formulated in a composition comprising a liposome as described elsewhere herein.

(vi) Systemic Administration of a ceDNA Vector Targeted to Muscle Tissue:

In some embodiments, a ceDNA vector for expression of FVIII protein as disclosed herein is formulated to be targeted to the muscle via indirect delivery administration, where the ceDNA is transported to the muscle as opposed to the liver. Accordingly, the technology described herein encompasses indirect administration of compositions comprising a ceDNA vector for expression of FVIII protein as disclosed herein to muscle tissue, for example, by systemic administration. Such compositions can be administered topically, intravenously (by bolus or continuous infusion), intracellular injection, intratissue injection, orally, by inhalation, intraperitoneally, subcutaneously, intracavity, and can be delivered by peristaltic means, if desired, or by other means known by those skilled in the art. The agent can be administered systemically, for example, by intravenous infusion, if so desired.

In some embodiments, uptake of a ceDNA vector for expression of FVIII protein as disclosed herein into muscle cells/tissue is increased by using a targeting agent or moiety that preferentially directs the vector to muscle tissue. Thus, in some embodiments, a capsid free, ceDNA vector can be concentrated in muscle tissue as compared to the amount of capsid free ceDNA vectors present in other cells or tissues of the body.

In some embodiments, the composition comprising a ceDNA vector for expression of FVIII protein as disclosed herein further comprises a targeting moiety to muscle cells. In other embodiments, the expressed gene product comprises a targeting moiety specific to the tissue in which it is desired to act. The targeting moiety can include any molecule, or complex of molecules, which is/are capable of targeting, interacting with, coupling with, and/or binding to an intracellular, cell surface, or extracellular biomarker of a cell or tissue. The biomarker can include, for example, a cellular protease, a kinase, a protein, a cell surface receptor, a lipid, and/or fatty acid. Other examples of biomarkers that the targeting moieties can target, interact with, couple with, and/or bind to include molecules associated with a particular disease. For example, the biomarkers can include cell surface receptors implicated in cancer development, such as epidermal growth factor receptor and transferrin receptor. The targeting moieties can include, but are not limited to, synthetic compounds, natural compounds or products, macromolecular entities, bioengineered molecules (e.g., polypeptides, lipids, polynucleotides, antibodies, antibody fragments), and small entities (e.g., small molecules, neurotransmitters, substrates, ligands, hormones and elemental compounds) that bind to molecules expressed in the target muscle tissue.

In certain embodiments, the targeting moiety may further comprise a receptor molecule, including, for example, receptors, which naturally recognize a specific desired molecule of a target cell. Such receptor molecules include receptors that have been modified to increase their specificity of interaction with a target molecule, receptors that have been modified to interact with a desired target molecule not naturally recognized by the receptor, and fragments of such receptors (see, e.g., Skerra, 2000, J. Molecular Recognition, 13:167-187). A preferred receptor is a chemokine receptor. Exemplary chemokine receptors have been described in, for example, Lapidot et al, 2002, Exp Hematol, 30:973-81 and Onuffer et al., 2002, Trends Pharmacol Sci, 23:459-67.

In other embodiments, the additional targeting moiety may comprise a ligand molecule, including, for example, ligands which naturally recognize a specific desired receptor of a target cell, such as a Transferrin (Tf) ligand. Such ligand molecules include ligands that have been modified to increase their specificity of interaction with a target receptor, ligands that have been modified to interact with a desired receptor not naturally recognized by the ligand, and fragments of such ligands.

In still other embodiments, the targeting moiety may comprise an aptamer. Aptamers are oligonucleotides that are selected to bind specifically to a desired molecular structure of the target cell. Aptamers typically are the products of an affinity selection process similar to the affinity selection of phage display (also known as in vitro molecular evolution). The process involves performing several tandem iterations of affinity separation, e.g., using a solid support to which the diseased immunogen is bound, followed by polymerase chain reaction (PCR) to amplify nucleic acids that bound to the immunogens. Each round of affinity separation thus enriches the nucleic acid population for molecules that successfully bind the desired immunogen. In this manner, a random pool of nucleic acids may be "educated" to yield aptamers that specifically bind target molecules. Aptamers typically are RNA, but may be DNA or analogs or derivatives thereof, such as, without limitation, peptide nucleic acids (PNAs) and phosphorothioate nucleic acids.

In some embodiments, the targeting moiety can comprise a photo-degradable ligand (i.e., a 'caged' ligand) that is released, for example, from a focused beam of light such that the capsid free, non-viral vectors or the gene product are targeted to a specific tissue.

It is also contemplated herein that the compositions be delivered to multiple sites in one or more muscles of the subject. That is, injections can be in at least 2, at least 3, at least 4, at least 5, at least 6, at least 7, at least 8, at least 9, at least 10, at least 15, at least 20, at least 25, at least 30, at least 35, at least 40, at least 45, at least 50, at least 55, at least 60, at least 65, at least 70, at least 75, at least 80, at least 85, at least 90, at least 95, at least 100 injections sites. Such sites can be spread over the area of a single muscle or can be distributed among multiple muscles.

B. Administration of the ceDNA Vector for Expression of FVIII Protein to Non-Muscle Locations In another embodiment, a ceDNA vector for expression of FVIII protein is administered to the liver. The ceDNA vector may also be administered to different regions of the eye such as the cornea and/or optic nerve The ceDNA vector may also be introduced into the spinal cord, brainstem (medulla oblongata, pons), midbrain (hypothalamus, thalamus, epithalamus, pituitary gland, substantia nigra, pineal gland), cerebellum, telencephalon (corpus striatum, cerebrum including the occipital, temporal, parietal and frontal lobes, cortex, basal ganglia, hippocampus and portaamygdala), limbic system, neocortex, corpus striatum, cerebrum, and inferior colliculus. The ceDNA vector may be delivered into the cerebrospinal fluid (e.g., by lumbar puncture). The ceDNA vector for expression of FVIII protein may further be administered intravascularly to the CNS in situations in which the blood-brain barrier has been perturbed (e.g., brain tumor or cerebral infarct).

In some embodiments, the ceDNA vector for expression of FVIII protein can be administered to the desired region(s) of the eye by any route known in the art, including but not limited to, intrathecal, intra-ocular, intracerebral, intraventricular, intravenous (e.g., in the presence of a sugar such as mannitol), intranasal, intra-aural, intra-ocular (e.g., intra-vitreous, sub-retinal, anterior chamber) and peri-ocular (e.g., sub-Tenon's region) delivery as well as intramuscular delivery with retrograde delivery to motor neurons.

In some embodiments, the ceDNA vector for expression of FVIII protein is administered in a liquid formulation by direct injection (e.g., stereotactic injection) to the desired region or compartment in the CNS. In other embodiments, the ceDNA vector can be provided by topical application to the desired region or by intra-nasal administration of an aerosol formulation. Administration to the eye may be by topical application of liquid droplets. As a further alternative, the ceDNA vector can be administered as a solid, slow-release formulation (see, e.g., U.S. Pat. No. 7,201,898). In yet additional embodiments, the ceDNA vector can used for retrograde transport to treat, ameliorate, and/or prevent diseases and disorders involving motor neurons (e.g., amyotrophic lateral sclerosis (ALS); spinal muscular atrophy (SMA), etc.). For example, the ceDNA vector can be delivered to muscle tissue from which it can migrate into neurons.

C. Ex Vivo Treatment

In some embodiments, cells are removed from a subject, a ceDNA vector for expression of FVIII protein as disclosed herein is introduced therein, and the cells are then replaced back into the subject. Methods of removing cells from subject for treatment ex vivo, followed by introduction back into the subject are known in the art (see, e.g., U.S. Pat. No. 5,399,346; the disclosure of which is incorporated herein in its entirety). Alternatively, a ceDNA vector is introduced into cells from another subject, into cultured cells, or into cells from any other suitable source, and the cells are administered to a subject in need thereof.

Cells transduced with a ceDNA vector for expression of FVIII protein as disclosed herein are preferably administered to the subject in a "therapeutically-effective amount" in combination with a pharmaceutical carrier. Those skilled in the art will appreciate that the therapeutic effects need not be complete or curative, as long as some benefit is provided to the subject.

In some embodiments, a ceDNA vector for expression of FVIII protein as disclosed herein can encode an FVIII protein as described herein (sometimes called a transgene or heterologous nucleotide sequence) that is to be produced in a cell in vitro, ex vivo, or in vivo. For example, in contrast to the use of the ceDNA vectors described herein in a method of treatment as discussed herein, in some embodiments a ceDNA vector for expression of FVIII protein may be introduced into cultured cells and the expressed FVIII protein isolated from the cells, e.g., for the production of antibodies and fusion proteins. In some embodiments, the cultured cells comprising a ceDNA vector for expression of FVIII protein as disclosed herein can be used for commercial production of antibodies or fusion proteins, e.g., serving as a cell source for small or large scale biomanufacturing of antibodies or fusion proteins. In alternative embodiments, a ceDNA vector for expression of FVIII protein as disclosed herein is introduced into cells in a host non-human subject, for in vivo production of antibodies or fusion proteins, including small scale production as well as for commercial large scale FVIII protein production.

The ceDNA vectors for expression of FVIII protein as disclosed herein can be used in both veterinary and medical applications. Suitable subjects for ex vivo gene delivery methods as described above include both avians (e.g., chickens, ducks, geese, quail, turkeys and pheasants) and mammals (e.g., humans, bovines, ovines, caprines, equines, felines, canines, and lagomorphs), with mammals being preferred. Human subjects are most preferred. Human subjects include neonates, infants, juveniles, and adults.

D. Dose Ranges

Provided herein are methods of treatment comprising administering to the subject an effective amount of a composition comprising a ceDNA vector encoding an FVIII protein as described herein. As will be appreciated by a skilled practitioner, the term "effective amount" refers to the amount of the ceDNA composition administered that results in expression of the FVIII protein in a "therapeutically effective amount" for the treatment of hemophilia A.

In vivo and/or in vitro assays can optionally be employed to help identify optimal dosage ranges for use. The precise dose to be employed in the formulation will also depend on the route of administration, and the seriousness of the condition, and should be decided according to the judgment of the person of ordinary skill in the art and each subject's circumstances. Effective doses can be extrapolated from dose-response curves derived from in vitro or animal model test systems.

A ceDNA vectors for expression of FVIII protein as disclosed herein is administered in sufficient amounts to transfect the cells of a desired tissue and to provide sufficient levels of gene transfer and expression without undue adverse effects. Conventional and pharmaceutically acceptable routes of administration include, but are not limited to, those described above in the "Administration" section, such as direct delivery to the selected organ (e.g., intraportal delivery to the liver), oral, inhalation (including intranasal and intratracheal delivery), intraocular, intravenous, intramuscular, subcutaneous, intradermal, intratumoral, and other parental routes of administration. Routes of administration can be combined, if desired.

The dose of the amount of a ceDNA vectors for expression of FVIII protein as disclosed herein required to achieve a particular "therapeutic effect," will vary based on several factors including, but not limited to: the route of nucleic acid administration, the level of gene or RNA expression required to achieve a therapeutic effect, the specific disease or disorder being treated, and the stability of the gene(s), RNA product(s), or resulting expressed protein(s). One of skill in the art can readily determine a ceDNA vector dose range to treat a patient having a particular disease or disorder based on the aforementioned factors, as well as other factors that are well known in the art.

Dosage regime can be adjusted to provide the optimum therapeutic response. For example, the oligonucleotide can be repeatedly administered, e.g., several doses can be administered daily, or the dose can be proportionally reduced as indicated by the exigencies of the therapeutic situation. One of ordinary skill in the art will readily be able to determine appropriate doses and schedules of administration of the subject oligonucleotides, whether the oligonucleotides are to be administered to cells or to subjects.

A "therapeutically effective dose" will fall in a relatively broad range that can be determined through clinical trials and will depend on the particular application (neural cells will require very small amounts, while systemic injection would require large amounts). For example, for direct in vivo injection into skeletal or cardiac muscle of a human subject, a therapeutically effective dose will be on the order of from about 1 μg to 100 g of the ceDNA vector. If exosomes or microparticles are used to deliver the ceDNA vector, then a therapeutically effective dose can be determined experimentally, but is expected to deliver from 1 μg to about 100 g of vector. Moreover, a therapeutically effective dose is an amount ceDNA vector that expresses a sufficient amount of the transgene to have an effect on the subject that results in a reduction in one or more symptoms of the disease, but does not result in significant off-target or significant adverse side effects. In one embodiment, a "therapeutically effective amount" is an amount of an expressed FVIII protein that is sufficient to produce a statistically significant, measurable change in expression of hemophilia A biomarker or reduction of a given disease symptom. Such effective amounts can be gauged in clinical trials as well as animal studies for a given ceDNA vector composition.

Formulation of pharmaceutically acceptable excipients and carrier solutions is well-known to those of skill in the art, as is the development of suitable dosing and treatment regimens for using the particular compositions described herein in a variety of treatment regimens.

For in vitro transfection, an effective amount of a ceDNA vectors for expression of FVIII protein as disclosed herein to be delivered to cells ($1\times10^6$ cells) will be on the order of 0.1 to 100 μg ceDNA vector, preferably 1 to 20 μg, and more preferably 1 to 15 μg or 8 to 10 μg. Larger ceDNA vectors will require higher doses. If exosomes or microparticles are used, an effective in vitro dose can be determined experimentally but would be intended to deliver generally the same amount of the ceDNA vector.

For the treatment of hemophilia A, the appropriate dosage of a ceDNA vector that expresses an FVIII protein as disclosed herein will depend on the specific type of disease to be treated, the type of a FVIII protein, the severity and course of the hemophilia A disease, previous therapy, the patient's clinical history and response to the antibody, and the discretion of the attending physician. The ceDNA vector encoding a FVIII protein is suitably administered to the patient at one time or over a series of treatments. Various dosing schedules including, but not limited to, single or multiple administrations over various time-points, bolus administration, and pulse infusion are contemplated herein.

Depending on the type and severity of the disease, a ceDNA vector is administered in an amount that the encoded FVIII protein is expressed at about 0.3 mg/kg to 100 mg/kg (e.g. 15 mg/kg-100 mg/kg, or any dosage within that range), by one or more separate administrations, or by continuous infusion. One typical daily dosage of the ceDNA vector is sufficient to result in the expression of the encoded FVIII protein at a range from about 15 mg/kg to 100 mg/kg or more, depending on the factors mentioned above. One exemplary dose of the ceDNA vector is an amount sufficient to result in the expression of the encoded FVIII protein as disclosed herein in a range from about 10 mg/kg to about 50 mg/kg. Thus, one or more doses of a ceDNA vector in an amount sufficient to result in the expression of the encoded FVIII protein at about 0.5 mg/kg, 1 mg/kg, 1.5 mg/kg, 2.0 mg/kg, 3 mg/kg, 4.0 mg/kg, 5 mg/kg, 10 mg/kg, 15 mg/kg, 20 mg/kg, 25 mg/kg, 30 mg/kg, 35 mg/kg, 40 mg/kg, 50 mg/kg, 60 mg/kg, 70 mg/kg, 80 mg/kg, 90 mg/kg, or 100 mg/kg (or any combination thereof) may be administered to the patient. In some embodiments, the ceDNA vector is an amount sufficient to result in the expression of the encoded FVIII protein for a total dose in the range of 50 mg to 2500 mg. An exemplary dose of a ceDNA vector is an amount sufficient to result in the total expression of the encoded FVIII protein at about 50 mg, about 100 mg, 200 mg, 300 mg, 400 mg, about 500 mg, about 600 mg, about 700 mg, about 720 mg, about 1000 mg, about 1050 mg, about 1100 mg, about 1200 mg, about 1300 mg, about 1400 mg, about 1500 mg, about 1600 mg, about 1700 mg, about 1800 mg, about 1900 mg, about 2000 mg, about 2050 mg, about 2100 mg, about 2200 mg, about 2300 mg, about 2400 mg, or about 2500 mg (or any combination thereof). As the expression of the FVIII protein from ceDNA vector can be carefully controlled by regulatory switches herein, or alternatively multiple dose of the ceDNA vector administered to the subject, the expression of the FVIII protein from the ceDNA vector can be controlled in such a way that the doses of the expressed FVIII protein may be administered intermittently, e.g. every week, every two weeks, every three weeks, every four weeks, every month, every two months, every three months, or every six months from the ceDNA vector. The progress of this therapy can be monitored by conventional techniques and assays.

In certain embodiments, a ceDNA vector is administered an amount sufficient to result in the expression of the encoded FVIII protein at a dose of 15 mg/kg, 30 mg/kg, 40 mg/kg, 45 mg/kg, 50 mg/kg, 60 mg/kg or a flat dose, e.g., 300 mg, 500 mg, 700 mg, 800 mg, or higher. In some embodiments, the expression of the FVIII protein from the ceDNA vector is controlled such that the FVIII protein is expressed every day, every other day, every week, every 2 weeks or every 4 weeks for a period of time. In some embodiments, the expression of the FVIII protein from the ceDNA vector is controlled such that the FVIII protein is expressed every 2 weeks or every 4 weeks for a period of time. In certain embodiments, the period of time is 6 months, one year, eighteen months, two years, five years, ten years, 15 years, 20 years, or the lifetime of the patient.

Treatment can involve administration of a single dose or multiple doses. In some embodiments, more than one dose can be administered to a subject; in fact, multiple doses can be administered as needed, because the ceDNA vector elicits does not elicit an anti-capsid host immune response due to the absence of a viral capsid. As such, one of skill in the art can readily determine an appropriate number of doses. The number of doses administered can, for example, be on the order of 1-100, preferably 2-20 doses.

Without wishing to be bound by any particular theory, the lack of typical anti-viral immune response elicited by administration of a ceDNA vector as described by the disclosure (i.e., the absence of capsid components) allows the ceDNA vector for expression of FVIII protein to be administered to a host on multiple occasions. In some embodiments, the number of occasions in which a heterologous nucleic acid is delivered to a subject is in a range of 2 to 10 times (e.g., 2, 3, 4, 5, 6, 7, 8, 9, or 10 times). In some embodiments, a ceDNA vector is delivered to a subject more than 10 times.

In some embodiments, a dose of a ceDNA vector for expression of FVIII protein as disclosed herein is administered to a subject no more than once per calendar day (e.g., a 24-hour period). In some embodiments, a dose of a ceDNA vector is administered to a subject no more than once per 2, 3, 4, 5, 6, or 7 calendar days. In some embodiments, a dose of a ceDNA vector for expression of FVIII protein as disclosed herein is administered to a subject no more than once per calendar week (e.g., 7 calendar days). In some embodiments, a dose of a ceDNA vector is administered to a subject no more than bi-weekly (e.g., once in a two calendar week period). In some embodiments, a dose of a ceDNA vector is administered to a subject no more than once per calendar month (e.g., once in 30 calendar days). In some embodiments, a dose of a ceDNA vector is administered to a subject no more than once per six calendar months. In some embodiments, a dose of a ceDNA vector is administered to a subject no more than once per calendar year (e.g., 365 days or 366 days in a leap year).

In particular embodiments, more than one administration (e.g., two, three, four or more administrations) of a ceDNA vector for expression of FVIII protein as disclosed herein may be employed to achieve the desired level of gene expression over a period of various intervals, e.g., daily, weekly, monthly, yearly, etc.

In some embodiments, a therapeutic a FVIII protein encoded by a ceDNA vector as disclosed herein can be regulated by a regulatory switch, inducible or repressible promotor so that it is expressed in a subject for at least 1 hour, at least 2 hours, at least 5 hours, at least 10 hours, at least 12 hours, at least 18 hours, at least 24 hours, at least 36 hours, at least 48 hours, at least 72 hours, at least 1 week, at least 2 weeks, at least 1 month, at least 2 months, at least 6 months, at least 12 months/one year, at least 2 years, at least 5 years, at least 10 years, at least 15 years, at least 20 years, at least 30 years, at least 40 years, at least 50 years or more. In one embodiment, the expression can be achieved by repeated administration of the ceDNA vectors described herein at predetermined or desired intervals. Alternatively, a ceDNA vector for expression of FVIII protein as disclosed herein can further comprise components of a gene editing system (e.g., CRISPR/Cas, TALENs, zinc finger endonucleases etc.) to permit insertion of the one or more nucleic acid sequences encoding the FVIII protein for substantially permanent treatment or "curing" the disease. Such ceDNA vectors comprising gene editing components are disclosed in International Application PCT/US18/64242, and can include the 5' and 3' homology arms (e.g., SEQ ID NO: 151-154, or sequences with at least 40%, 50%, 60%, 70% or 80% homology thereto) for insertion of the nucleic acid encoding the a FVIII protein into safe harbor regions, such as, but not including albumin gene or CCR5 gene. By way of example, a ceDNA vector expressing a FVIII protein can comprise at least one genomic safe harbor (GSH)-specific homology arms for insertion of the FVIII transgene into a genomic safe harbor is disclosed in International Patent Application PCT/US2019/020225, filed on Mar. 1, 2019, which is incorporated herein in its entirety by reference.

The duration of treatment depends upon the subject's clinical progress and responsiveness to therapy. Continuous, relatively low maintenance doses are contemplated after an initial higher therapeutic dose.

E. Unit Dosage Forms

In some embodiments, the pharmaceutical compositions comprising a ceDNA vector for expression of FVIII protein as disclosed herein can conveniently be presented in unit dosage form. A unit dosage form will typically be adapted to one or more specific routes of administration of the pharmaceutical composition. In some embodiments, the unit dosage form is adapted for droplets to be administered directly to the eye. In some embodiments, the unit dosage form is adapted for administration by inhalation. In some embodiments, the unit dosage form is adapted for administration by a vaporizer. In some embodiments, the unit dosage form is adapted for administration by a nebulizer. In some embodiments, the unit dosage form is adapted for administration by an aerosolizer. In some embodiments, the unit dosage form is adapted for oral administration, for buccal administration, or for sublingual administration. In some embodiments, the unit dosage form is adapted for intravenous, intramuscular, or subcutaneous administration. In some embodiments, the unit dosage form is adapted for subretinal injection, suprachoroidal injection or intravitreal injection.

In some embodiments, the unit dosage form is adapted for intrathecal or intracerebroventricular administration. In some embodiments, the pharmaceutical composition is formulated for topical administration. The amount of active ingredient which can be combined with a carrier material to produce a single dosage form will generally be that amount of the compound which produces a therapeutic effect.

X. Methods of Treatment

The technology described herein also demonstrates methods for making, as well as methods of using the disclosed ceDNA vectors for expression of FVIII protein in a variety of ways, including, for example, ex vivo, ex situ, in vitro and in vivo applications, methodologies, diagnostic procedures, and/or gene therapy regimens.

In one embodiment, the expressed therapeutic FVIII protein expressed from a ceDNA vector as disclosed herein is functional for the treatment of disease. In a preferred embodiment, the therapeutic FVIII protein does not cause an immune system reaction, unless so desired.

Provided herein is a method of treating hemophilia A in a subject comprising introducing into a target cell in need thereof (for example, a muscle cell or tissue, or other affected cell type) of the subject a therapeutically effective amount of a ceDNA vector for expression of FVIII protein as disclosed herein, optionally with a pharmaceutically acceptable carrier. While the ceDNA vector can be introduced in the presence of a carrier, such a carrier is not required. The ceDNA vector implemented comprises a nucleotide sequence encoding an FVIII protein as described herein useful for treating the disease. In particular, a ceDNA vector for expression of FVIII protein as disclosed herein may comprise a desired FVIII protein DNA sequence operably linked to control elements capable of directing transcription of the desired FVIII protein encoded by the exogenous DNA sequence when introduced into the subject. The ceDNA vector for expression of FVIII protein as disclosed herein can be administered via any suitable route as provided above, and elsewhere herein.

Disclosed herein are ceDNA vector compositions and formulations for expression of FVIII protein as disclosed herein that include one or more of the ceDNA vectors of the present invention together with one or more pharmaceutically-acceptable buffers, diluents, or excipients. Such compositions may be included in one or more diagnostic or therapeutic kits, for diagnosing, preventing, treating or ameliorating one or more symptoms of hemophilia A. In one aspect the disease, injury, disorder, trauma or dysfunction is a human disease, injury, disorder, trauma or dysfunction.

Another aspect of the technology described herein provides a method for providing a subject in need thereof with a diagnostically- or therapeutically-effective amount of a ceDNA vector for expression of FVIII protein as disclosed herein, the method comprising providing to a cell, tissue or organ of a subject in need thereof, an amount of the ceDNA vector as disclosed herein; and for a time effective to enable expression of the FVIII protein from the ceDNA vector thereby providing the subject with a diagnostically- or a therapeutically-effective amount of the FVIII protein expressed by the ceDNA vector. In a further aspect, the subject is human.

Another aspect of the technology described herein provides a method for diagnosing, preventing, treating, or ameliorating at least one or more symptoms of hemophilia A, a disorder, a dysfunction, an injury, an abnormal condition, or trauma in a subject. In an overall and general sense, the method includes at least the step of administering to a subject in need thereof one or more of the disclosed ceDNA vector for FVIII protein production, in an amount and for a time sufficient to diagnose, prevent, treat or ameliorate the one or more symptoms of the disease, disorder, dysfunction, injury, abnormal condition, or trauma in the subject. In such an embodiment, the subject can be evaluated for efficacy of the FVIII protein, or alternatively, detection of the FVIII protein or tissue location (including cellular and subcellular location) of the FVIII protein in the subject. As such, the ceDNA vector for expression of FVIII protein as disclosed herein can be used as an in vivo diagnostic tool, e.g., for the detection of cancer or other indications. In a further aspect, the subject is human.

Another aspect is use of a ceDNA vector for expression of FVIII protein as disclosed herein as a tool for treating or reducing one or more symptoms of hemophilia A or disease states. There are a number of inherited diseases in which defective genes are known, and typically fall into two classes: deficiency states, usually of enzymes, which are generally inherited in a recessive manner, and unbalanced states, which may involve regulatory or structural proteins, and which are typically but not always inherited in a dominant manner. For unbalanced disease states, a ceDNA vector for expression of FVIII protein as disclosed herein can be used to create hemophilia A state in a model system, which could then be used in efforts to counteract the disease state. Thus, the ceDNA vector for expression of FVIII protein as disclosed herein permit the treatment of genetic diseases. As used herein, hemophilia A state is treated by partially or wholly remedying the deficiency or imbalance that causes the disease or makes it more severe.

A. Host Cells

In some embodiments, a ceDNA vector for expression of FVIII protein as disclosed herein delivers the FVIII protein transgene into a subject host cell. In some embodiments, the cells are photoreceptor cells. In some embodiments, the cells are RPE cells. In some embodiments, the subject host cell is a human host cell, including, for example blood cells, stem cells, hematopoietic cells, $CD34^+$ cells, liver cells, cancer cells, vascular cells, muscle cells, pancreatic cells, neural cells, ocular or retinal cells, epithelial or endothelial cells, dendritic cells, fibroblasts, or any other cell of mammalian origin, including, without limitation, hepatic (i.e., liver) cells, lung cells, cardiac cells, pancreatic cells, intestinal cells, diaphragmatic cells, renal (i.e., kidney) cells, neural cells, blood cells, bone marrow cells, or any one or more selected tissues of a subject for which gene therapy is contemplated. In one aspect, the subject host cell is a human host cell.

The present disclosure also relates to recombinant host cells as mentioned above, including a ceDNA vector for expression of FVIII protein as disclosed herein. Thus, one can use multiple host cells depending on the purpose as is obvious to the skilled artisan. A construct or a ceDNA vector for expression of FVIII protein as disclosed herein including donor sequence is introduced into a host cell so that the donor sequence is maintained as a chromosomal integrant as described earlier. The term host cell encompasses any progeny of a parent cell that is not identical to the parent cell due to mutations that occur during replication. The choice of a host cell will to a large extent depend upon the donor sequence and its source.

The host cell may also be a eukaryote, such as a mammalian, insect, plant, or fungal cell. In one embodiment, the host cell is a human cell (e.g., a primary cell, a stem cell, or an immortalized cell line). In some embodiments, the host cell can be administered a ceDNA vector for expression of FVIII protein as disclosed herein ex vivo and then delivered to the subject after the gene therapy event. A host cell can be any cell type, e.g., a somatic cell or a stem cell, an induced pluripotent stem cell, or a blood cell, e.g., T-cell or B-cell, or bone marrow cell. In certain embodiments, the host cell is an allogenic cell. For example, T-cell genome engineering is useful for cancer immunotherapies, disease modulation such as HIV therapy (e.g., receptor knock out, such as CXCR4 and CCR5) and immunodeficiency therapies. MHC receptors on B-cells can be targeted for immunotherapy. In some embodiments, gene modified host cells, e.g., bone marrow stem cells, e.g., $CD34^+$ cells, or induced pluripotent stem cells can be transplanted back into a patient for expression of a therapeutic protein.

B. Additional Diseases for Gene Therapy:

In general, a ceDNA vector for expression of FVIII protein as disclosed herein can be used to deliver any FVIII protein in accordance with the description above to treat, prevent, or ameliorate the symptoms associated with hemophilia A related to an aberrant protein expression or gene expression in a subject.

In some embodiments, a ceDNA vector for expression of FVIII protein as disclosed herein can be used to deliver an FVIII protein to skeletal, cardiac or diaphragm muscle, for production of an FVIII protein for secretion and circulation in the blood or for systemic delivery to other tissues to treat, ameliorate, and/or prevent hemophilia A.

The a ceDNA vector for expression of FVIII protein as disclosed herein can be administered to the lungs of a subject by any suitable means, optionally by administering an aerosol suspension of respirable particles comprising the ceDNA vectors, which the subject inhales. The respirable particles can be liquid or solid. Aerosols of liquid particles comprising the ceDNA vectors may be produced by any suitable means, such as with a pressure-driven aerosol nebulizer or an ultrasonic nebulizer, as is known to those of skill in the art. See, e.g., U.S. Pat. No. 4,501,729. Aerosols of solid particles comprising the ceDNA vectors may likewise be produced with any solid particulate medicament aerosol generator, by techniques known in the pharmaceutical art.

In some embodiments, a ceDNA vector for expression of FVIII protein as disclosed herein can be administered to tissues of the CNS (e.g., brain, eye).

Ocular disorders that may be treated, ameliorated, or prevented with a ceDNA vector for expression of FVIII protein as disclosed herein include ophthalmic disorders involving the retina, posterior tract, and optic nerve (e.g., retinitis pigmentosa, diabetic retinopathy and other retinal degenerative diseases, uveitis, age-related macular degeneration, glaucoma). Many ophthalmic diseases and disorders are associated with one or more of three types of indications: (1) angiogenesis, (2) inflammation, and (3) degeneration. In some embodiments, the ceDNA vector as disclosed herein can be employed to deliver anti-angiogenic factors; anti-inflammatory factors; factors that retard cell degeneration, promote cell sparing, or promote cell growth and combinations of the foregoing. Diabetic retinopathy, for example, is characterized by angiogenesis. Diabetic retinopathy can be treated by delivering one or more anti-angiogenic antibodies or fusion proteins either intraocularly (e.g., in the vitreous) or periocularly (e.g., in the sub-Tenon's region). Additional ocular diseases that may be treated, ameliorated, or prevented with the ceDNA vectors of the invention include geographic atrophy, vascular or "wet" macular degeneration, PKU, Leber Congenital Amaurosis (LCA), Usher syndrome, pseudoxanthoma elasticum (PXE), x-linked retinitis pigmentosa (XLRP), x-linked retinoschisis (XLRS), Choroideremia, Leber hereditary optic neuropathy (LHON), Archomatopsia, cone-rod dystrophy, Fuchs endothelial corneal dystrophy, diabetic macular edema and ocular cancer and tumors.

In some embodiments, inflammatory ocular diseases or disorders (e.g., uveitis) can be treated, ameliorated, or prevented by a ceDNA vector for expression of FVIII protein as disclosed herein. One or more anti-inflammatory antibodies or fusion proteins can be expressed by intraocular (e.g., vitreous or anterior chamber) administration of the ceDNA vector as disclosed herein. In some embodiments, a ceDNA vector for expression of FVIII protein as disclosed herein can encode an FVIII protein that is associated with transgene encoding a reporter polypeptide (e.g., an enzyme such as Green Fluorescent Protein, or alkaline phosphatase). In some embodiments, a transgene that encodes a reporter protein useful for experimental or diagnostic purposes, is selected from any of: β-lactamase, β-galactosidase (LacZ), alkaline phosphatase, thymidine kinase, green fluorescent protein (GFP), chloramphenicol acetyltransferase (CAT), luciferase, and others well known in the art. In some aspects, ceDNA vectors expressing an FVIII protein linked to a reporter polypeptide may be used for diagnostic purposes, as well as to determine efficacy or as markers of the ceDNA vector's activity in the subject to which they are administered.

C. Testing for Successful Gene Expression Using a ceDNA Vector

Assays well known in the art can be used to test the efficiency of gene delivery of an FVIII protein by a ceDNA vector can be performed in both in vitro and in vivo models. Levels of the expression of the FVIII protein by ceDNA can be assessed by one skilled in the art by measuring mRNA and protein levels of the FVIII protein (e.g., reverse transcription PCR, western blot analysis, and enzyme-linked immunosorbent assay (ELISA)). In one embodiment, ceDNA comprises a reporter protein that can be used to assess the expression of the FVIII protein, for example by examining the expression of the reporter protein by fluorescence microscopy or a luminescence plate reader. For in vivo applications, protein function assays can be used to test the functionality of a given FVIII protein to determine if gene expression has successfully occurred. One skilled will be able to determine the best test for measuring functionality of an FVIII protein expressed by the ceDNA vector in vitro or in vivo.

It is contemplated herein that the effects of gene expression of an FVIII protein from the ceDNA vector in a cell or subject can last for at least 1 month, at least 2 months, at least 3 months, at least four months, at least 5 months, at least six months, at least 10 months, at least 12 months, at least 18 months, at least 2 years, at least 5 years, at least 10 years, at least 20 years, or can be permanent.

In some embodiments, an FVIII protein in the expression cassette, expression construct, or ceDNA vector described herein can be codon optimized for the host cell. As used herein, the term "codon optimized" or "codon optimization" refers to the process of modifying a nucleic acid sequence for enhanced expression in the cells of the vertebrate of interest, e.g., mouse or human (e.g., humanized), by replacing at least one, more than one, or a significant number of codons of the native sequence (e.g., a prokaryotic sequence) with codons that are more frequently or most frequently used in the genes of that vertebrate. Various species exhibit particular bias for certain codons of a particular amino acid. Typically, codon optimization does not alter the amino acid sequence of the original translated protein. Optimized codons can be determined using e.g., Aptagen's Gene Forge® codon optimization and custom gene synthesis platform (Aptagen, Inc.) or another publicly available database.

D. Determining Efficacy by Assessing FVIII Protein Expression from the ceDNA Vector Essentially any method known in the art for determining protein expression can be used to analyze expression of a FVIII protein from a ceDNA vector. Non-limiting examples of such methods/assays include enzyme-linked immunoassay (ELISA), affinity ELISA, ELISPOT, serial dilution, flow cytometry, surface plasmon resonance analysis, kinetic exclusion assay, mass spectrometry, Western blot, immunoprecipitation, and PCR.

For assessing FVIII protein expression in vivo, a biological sample can be obtained from a subject for analysis. Exemplary biological samples include a biofluid sample, a body fluid sample, blood (including whole blood), serum, plasma, urine, saliva, a biopsy and/or tissue sample etc. A biological sample or tissue sample can also refer to a sample of tissue or fluid isolated from an individual including, but not limited to, tumor biopsy, stool, spinal fluid, pleural fluid, nipple aspirates, lymph fluid, the external sections of the skin, respiratory, intestinal, and genitourinary tracts, tears, saliva, breast milk, cells (including, but not limited to, blood cells), tumors, organs, and also samples of in vitro cell culture constituent. The term also includes a mixture of the above-mentioned samples. The term "sample" also includes untreated or pretreated (or pre-processed) biological samples. In some embodiments, the sample used for the assays and methods described herein comprises a serum sample collected from a subject to be tested.

E. Determining Efficacy of the Expressed FVIII Protein by Clinical Parameters

The efficacy of a given FVIII protein expressed by a ceDNA vector for hemophilia A (i.e., functional expression) can be determined by the skilled clinician. However, a treatment is considered "effective treatment," as the term is used herein, if any one or all of the signs or symptoms of hemophilia A is/are altered in a beneficial manner, or other clinically accepted symptoms or markers of disease are improved, or ameliorated, e.g., by at least 10% following treatment with a ceDNA vector encoding a therapeutic FVIII protein as described herein. Efficacy can also be measured by failure of an individual to worsen as assessed by stabilization of hemophilia A, or the need for medical interventions (i.e., progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting hemophilia A, e.g., arresting, or slowing progression of hemophilia A; or (2) relieving the hemophilia A, e.g., causing regression of a hemophilia A symptom; and (3) preventing or reducing the likelihood of the development of the hemophilia A disease, or preventing secondary diseases/disorders associated with hemophilia A. An effective amount for the treatment of a disease means that amount which, when administered to a mammal in need thereof, is sufficient to result in effective treatment as that term is defined herein, for that disease. Efficacy of an agent can be determined by assessing physical indicators that are particular to hemophilia A disease. A physician can assess for any one or more of clinical symptoms of hemophilia A which include: unexplained and excessive bleeding from cuts or injuries, or after surgery or dental work; many large or deep bruises; unusual bleeding after vaccinations; pain, swelling or tightness in your joints; blood in your urine or stool; nosebleeds without a known cause; in infants, unexplained irritability.

XI. Various Applications of ceDNA Vectors Expressing Antibodies or Fusion Proteins As disclosed herein, the compositions and ceDNA vectors for expression of FVIII protein as described herein can be used to express an FVIII protein for a range of purposes. In one embodiment, the ceDNA vector expressing an FVIII protein can be used to create a somatic transgenic animal model harboring the transgene, e.g., to study the function or disease progression of hemophilia A. In some embodiments, a ceDNA vector expressing an FVIII protein is useful for the treatment, prevention, or amelioration of hemophilia A states or disorders in a mammalian subject.

In some embodiments the FVIII protein can be expressed from the ceDNA vector in a subject in a sufficient amount to treat a disease associated with increased expression, increased activity of the gene product, or inappropriate upregulation of a gene.

In some embodiments the FVIII protein can be expressed from the ceDNA vector in a subject in a sufficient amount to treat hemophilia A with a reduced expression, lack of expression or dysfunction of a protein.

It will be appreciated by one of ordinary skill in the art that the transgene may not be an open reading frame of a gene to be transcribed itself; instead it may be a promoter region or repressor region of a target gene, and the ceDNA vector may modify such region with the outcome of so modulating the expression of the FVIII gene.

The compositions and ceDNA vectors for expression of FVIII protein as disclosed herein can be used to deliver an FVIII protein for various purposes as described above.

In some embodiments, the transgene encodes one or more FVIII proteins which are useful for the treatment, amelioration, or prevention of hemophilia A states in a mammalian subject. The FVIII protein expressed by the ceDNA vector is administered to a patient in a sufficient amount to treat hemophilia A associated with an abnormal gene sequence, which can result in any one or more of the following: increased protein expression, over activity of the protein, reduced expression, lack of expression or dysfunction of the target gene or protein.

In some embodiments, the ceDNA vectors for expression of FVIII protein as disclosed herein are envisioned for use in diagnostic and screening methods, whereby an FVIII protein is transiently or stably expressed in a cell culture system, or alternatively, a transgenic animal model.

Another aspect of the technology described herein provides a method of transducing a population of mammalian cells with a ceDNA vector for expression of FVIII protein as disclosed herein. In an overall and general sense, the method includes at least the step of introducing into one or more cells of the population, a composition that comprises an effective amount of one or more of the ceDNA vectors for expression of FVIII protein as disclosed herein.

Additionally, the present invention provides compositions, as well as therapeutic and/or diagnostic kits that include one or more of the disclosed ceDNA vectors for expression of FVIII protein as disclosed herein or ceDNA compositions, formulated with one or more additional ingredients, or prepared with one or more instructions for their use.

A cell to be administered a ceDNA vector for expression of FVIII protein as disclosed herein may be of any type, including but not limited to neural cells (including cells of the peripheral and central nervous systems, in particular, brain cells), lung cells, retinal cells, epithelial cells (e.g., gut and respiratory epithelial cells), muscle cells, dendritic cells, pancreatic cells (including islet cells), hepatic cells, myocardial cells, bone cells (e.g., bone marrow stem cells), hematopoietic stem cells, spleen cells, keratinocytes, fibroblasts, endothelial cells, prostate cells, germ cells, and the like. Alternatively, the cell may be any progenitor cell. As a further alternative, the cell can be a stem cell (e.g., neural stem cell, liver stem cell). As still a further alternative, the cell may be a cancer or tumor cell. Moreover, the cells can be from any species of origin, as indicated above.

A. Production and Purification of ceDNA Vectors Expressing FVIII

The ceDNA vectors disclosed herein are to be used to produce FVIII protein either in vitro or in vivo. The FVIII proteins produced in this manner can be isolated, tested for a desired function, and purified for further use in research or as a therapeutic treatment. Each system of protein production has its own advantages/disadvantages. While proteins produced in vitro can be easily purified and can proteins in a short time, proteins produced in vivo can have post-translational modifications, such as glycosylation.

FVIII therapeutic protein produced using ceDNA vectors can be purified using any method known to those of skill in the art, for example, ion exchange chromatography, affinity chromatography, precipitation, or electrophoresis.

An FVIII therapeutic protein produced by the methods and compositions described herein can be tested for binding to the desired target protein.

EXAMPLES

The following examples are provided by way of illustration not limitation. It will be appreciated by one of ordinary skill in the art that ceDNA vectors can be constructed from any of the wild-type or modified ITRs described herein, and that the following exemplary methods can be used to construct and assess the activity of such ceDNA vectors. While the methods are exemplified with certain ceDNA vectors, they are applicable to any ceDNA vector in keeping with the description.

Example 1: Constructing ceDNA Vectors Using an Insect Cell-Based Method

Production of the ceDNA vectors using a polynucleotide construct template is described in Example 1 of PCT/US18/49996, which is incorporated herein in its entirety by reference. For example, a polynucleotide construct template used for generating the ceDNA vectors of the present invention can be a ceDNA-plasmid, a ceDNA-Bacmid, and/or a ceDNA-baculovirus. Without being limited to theory, in a permissive host cell, in the presence of e.g., Rep, the polynucleotide construct template having two symmetric ITRs and an expression construct, where at least one of the ITRs is modified relative to a wild-type ITR sequence, replicates to produce ceDNA vectors. ceDNA vector production undergoes two steps: first, excision ("rescue") of template from the template backbone (e.g. ceDNA-plasmid, ceDNA-bacmid, ceDNA-baculovirus genome etc.) via Rep proteins, and second, Rep mediated replication of the excised ceDNA vector.

Figure 1B:
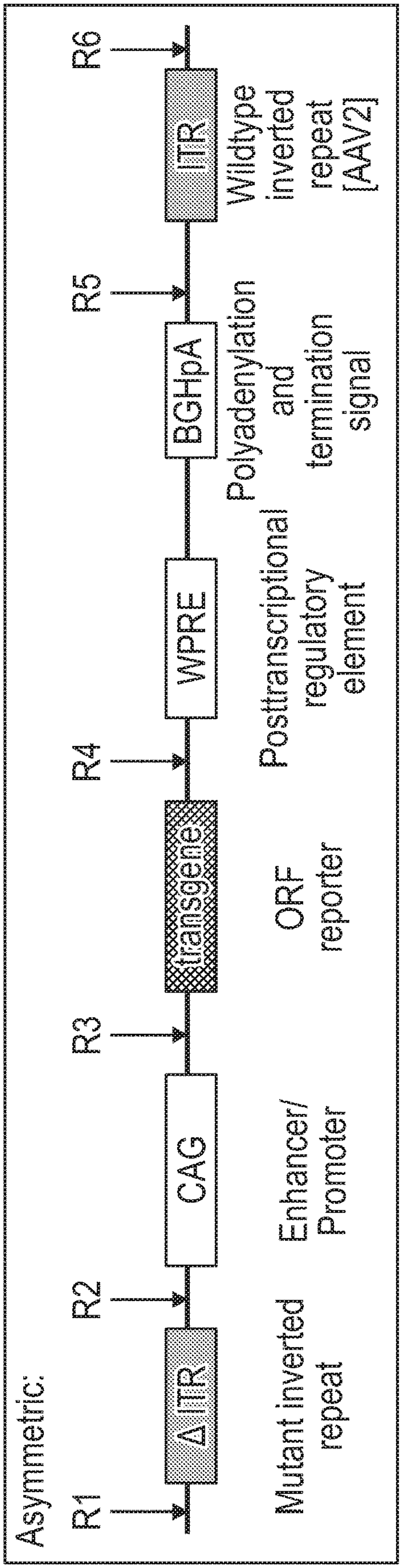
FIG. 1B illustrates an exemplary structure of a ceDNA vector for expression of the FVIII as disclosed herein comprising asymmetric ITRs with an expression cassette containing CAG promoter, WPRE, and BGHpA. An open reading frame (ORF) encoding the FVIII transgene can be inserted into the cloning site between CAG promoter and WPRE. The expression cassette is flanked by two inverted terminal repeats (ITRs)—a modified ITR on the upstream (5'-end) and a wild-type ITR on the downstream (3'-end) of the expression cassette.
Figure 1C:
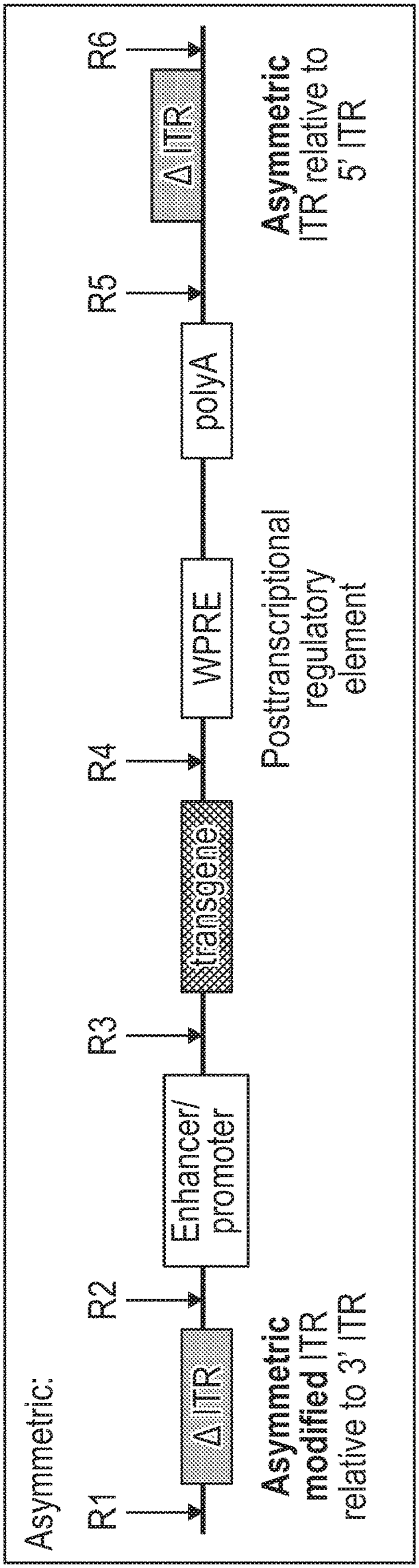
FIG. 1C illustrates an exemplary structure of a ceDNA vector for expression of the FVIII as disclosed herein comprising asymmetric ITRs, with an expression cassette containing an enhancer/promoter, the FVIII transgene, a post transcriptional element (WPRE), and a polyA signal. An open reading frame (ORF) allows insertion of the FVIII transgene into the cloning site between CAG promoter and WPRE. The expression cassette is flanked by two inverted terminal repeats (ITRs) that are asymmetrical with respect to each other; a modified ITR on the upstream (5'-end) and a modified ITR on the downstream (3'-end) of the expression cassette, where the 5' ITR and the 3'ITR are both modified ITRs but have different modifications (i.e., they do not have the same modifications).
Figure 1D:
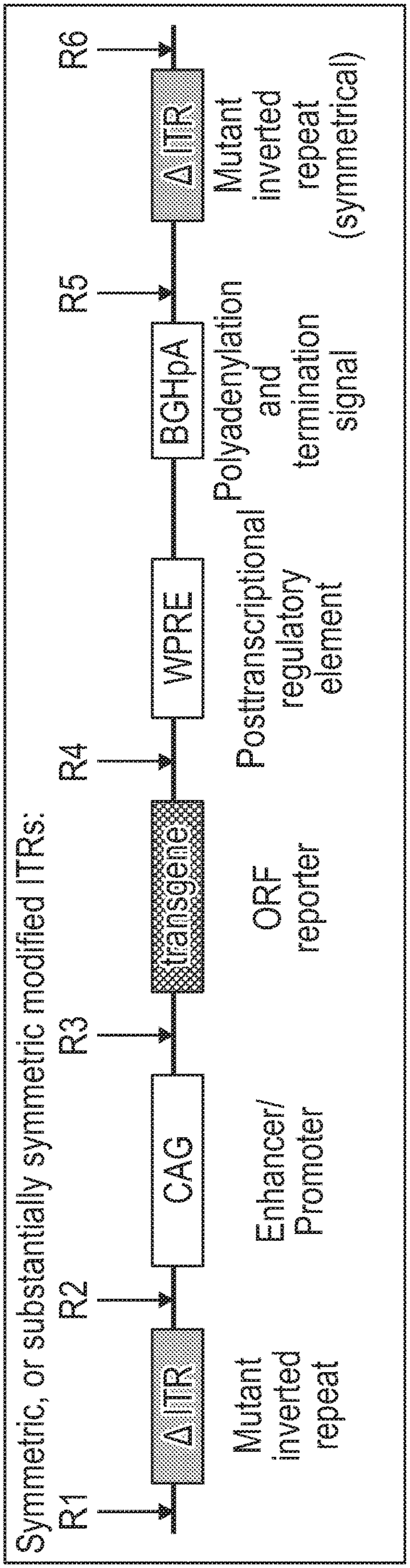
FIG. 1D illustrates an exemplary structure of a ceDNA vector for expression of the FVIII as disclosed herein, comprising symmetric modified ITRs, or substantially symmetrical modified ITRs as defined herein, with an expression cassette containing CAG promoter, WPRE, and BGHpA. An open reading frame (ORF) encoding the FVIII transgene is inserted into the cloning site between CAG promoter and WPRE. The expression cassette is flanked by two modified inverted terminal repeats (ITRs), where the 5' modified ITR and the 3' modified ITR are symmetrical or substantially symmetrical.
Figure 1E:
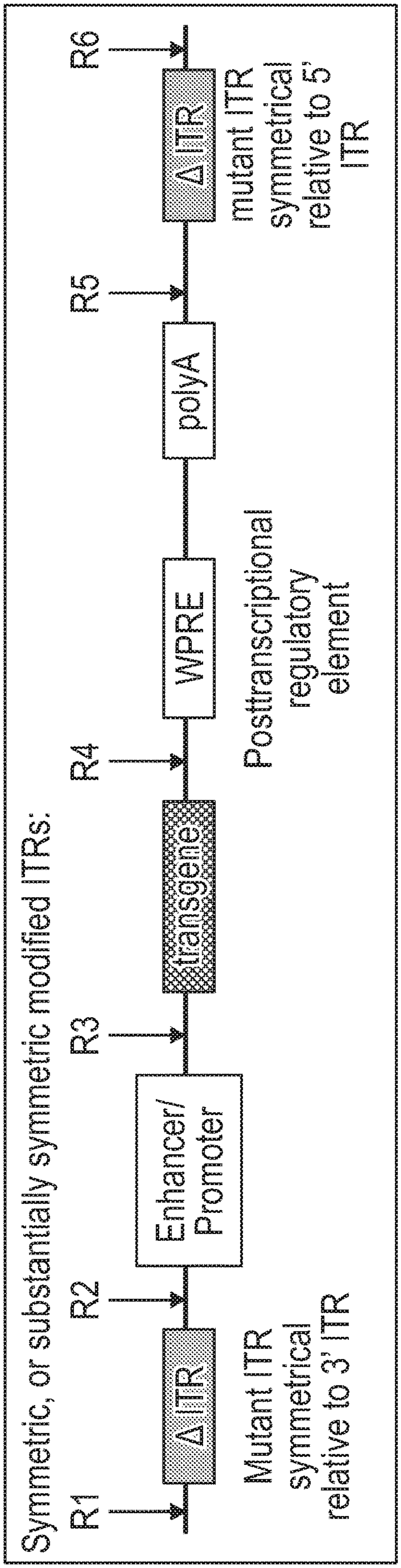
FIG. 1E illustrates an exemplary structure of a ceDNA vector for expression of the FVIII as disclosed herein comprising symmetric modified ITRs, or substantially symmetrical modified ITRs as defined herein, with an expression cassette containing an enhancer/promoter, a transgene, a post transcriptional element (WPRE), and a polyA signal. An open reading frame (ORF) allows insertion of a transgene (e.g., the FVIII) into the cloning site between CAG promoter and WPRE. The expression cassette is flanked by two modified inverted terminal repeats (ITRs), where the 5' modified ITR and the 3' modified ITR are symmetrical or substantially symmetrical.
Figure 1F:
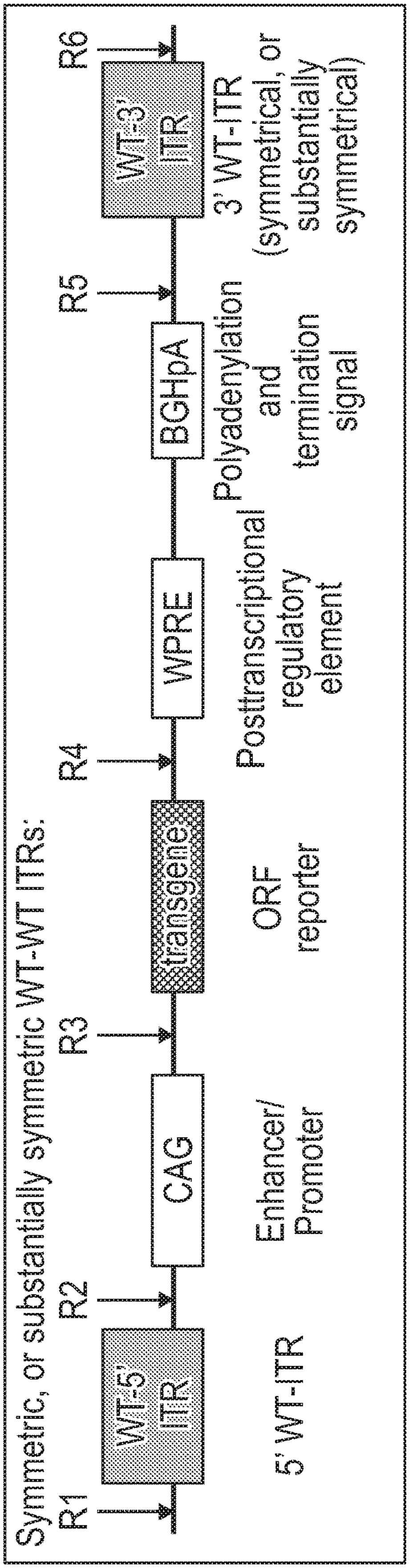
FIG. 1F illustrates an exemplary structure of a ceDNA vector for expression of the FVIII as disclosed herein, comprising symmetric WT-ITRs, or substantially symmetrical WT-ITRs as defined herein, with an expression cassette containing CAG promoter, WPRE, and BGHpA. An open reading frame (ORF) encoding a transgene (e.g., the FVIII) is inserted into the cloning site between CAG promoter and WPRE. The expression cassette is flanked by two wild type inverted terminal repeats (WT-ITRs), where the 5' WT-ITR and the 3' WT ITR are symmetrical or substantially symmetrical.
Figure 1G:
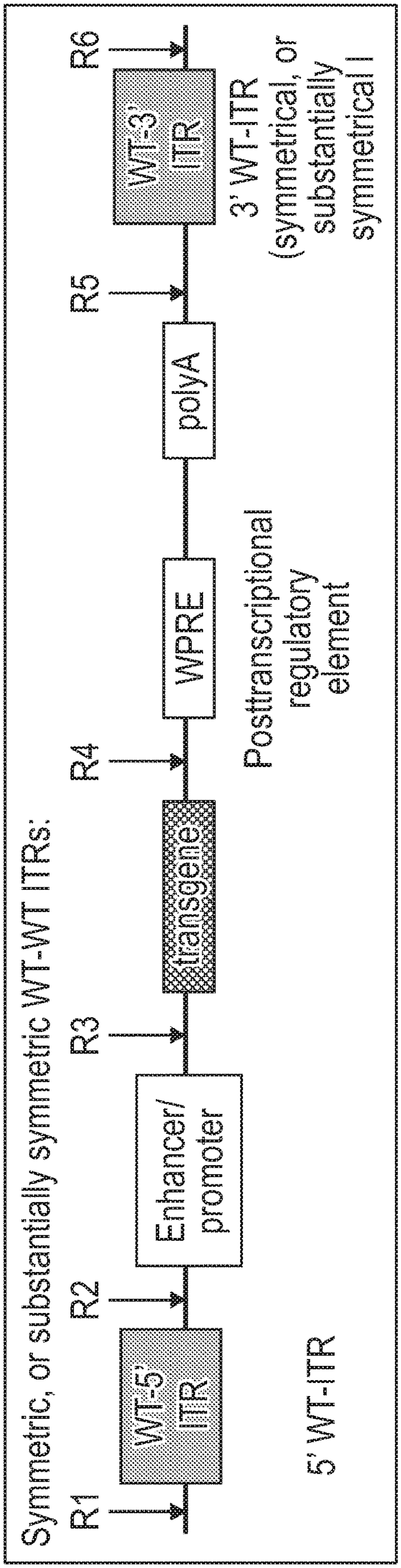
FIG. 1G illustrates an exemplary structure of a ceDNA vector for expression of the FVIII as disclosed herein, comprising symmetric modified ITRs, or substantially symmetrical modified ITRs as defined herein, with an expression cassette containing an enhancer/promoter, a transgene (e.g., the FVIII), a post transcriptional element (WPRE), and a polyA signal. An open reading frame (ORF) allows insertion of a transgene (e.g., the FVIII) into the cloning site between CAG promoter and WPRE. The expression cassette is flanked by two wild type inverted terminal repeats (WT-ITRs), where the 5' WT-ITR and the 3' WT ITR are symmetrical or substantially symmetrical.

An exemplary method to produce ceDNA vectors is from a ceDNA-plasmid as described herein. Referring to FIGS. 1A and 1B, the polynucleotide construct template of each of the ceDNA-plasmids includes both a left modified ITR and a right modified ITR with the following between the ITR sequences: (i) an enhancer/promoter; (ii) a cloning site for a transgene; (iii) a posttranscriptional response element (e.g. the woodchuck hepatitis virus posttranscriptional regulatory element (WPRE)); and (iv) a poly-adenylation signal (e.g. from bovine growth hormone gene (BGHpA). Unique restriction endonuclease recognition sites (R1-R6) (shown in FIG. 1A and FIG. 1B) were also introduced between each component to facilitate the introduction of new genetic components into the specific sites in the construct. R3 (PmeI) GTTTAAAC (SEQ ID NO: 123) and R4 (PacI) TTAATTAA (SEQ ID NO: 124) enzyme sites are engineered into the cloning site to introduce an open reading frame of a transgene. These sequences were cloned into a pFastBac HT B plasmid obtained from ThermoFisher Scientific.

Production of ceDNA-Bacmids:

DH10Bac competent cells (MAX EFFICIENCY® DH10Bac™ Competent Cells, Thermo Fisher) were transformed with either test or control plasmids following a protocol according to the manufacturer's instructions. Recombination between the plasmid and a baculovirus shuttle vector in the DH10Bac cells were induced to generate recombinant ceDNA-bacmids. The recombinant bacmids were selected by screening a positive selection based on blue-white screening in *E. coli* (Φ80dlacZΔM15 marker provides α-complementation of the β-galactosidase gene from the bacmid vector) on a bacterial agar plate containing X-gal and IPTG with antibiotics to select for transformants and maintenance of the bacmid and transposase plasmids. White colonies caused by transposition that disrupts the β-galactoside indicator gene were picked and cultured in 10 ml of media.

The recombinant ceDNA-bacmids were isolated from the *E. coli* and transfected into Sf9 or Sf21 insect cells using FugeneHD to produce infectious baculovirus. The adherent Sf9 or Sf21 insect cells were cultured in 50 ml of media in T25 flasks at 25° C. Four days later, culture medium (containing the P0 virus) was removed from the cells, filtered through a 0.45 μm filter, separating the infectious baculovirus particles from cells or cell debris.

Optionally, the first generation of the baculovirus (P0) was amplified by infecting naïve Sf9 or Sf21 insect cells in 50 to 500 ml of media. Cells were maintained in suspension cultures in an orbital shaker incubator at 130 rpm at 25° C., monitoring cell diameter and viability, until cells reach a diameter of 18-19 nm (from a naïve diameter of 14-15 nm), and a density of ~4.0E+6 cells/mL. Between 3 and 8 days post-infection, the P1 baculovirus particles in the medium were collected following centrifugation to remove cells and debris then filtration through a 0.45 μm filter.

The ceDNA-baculovirus comprising the test constructs were collected and the infectious activity, or titer, of the baculovirus was determined. Specifically, four×20 ml Sf9 cell cultures at 2.5E+6 cells/ml were treated with P1 baculovirus at the following dilutions: 1/1000, 1/10,000, 1/50,000, 1/100,000, and incubated at 25-27° C. Infectivity was determined by the rate of cell diameter increase and cell cycle arrest, and change in cell viability every day for 4 to 5 days.

Figure 8A:
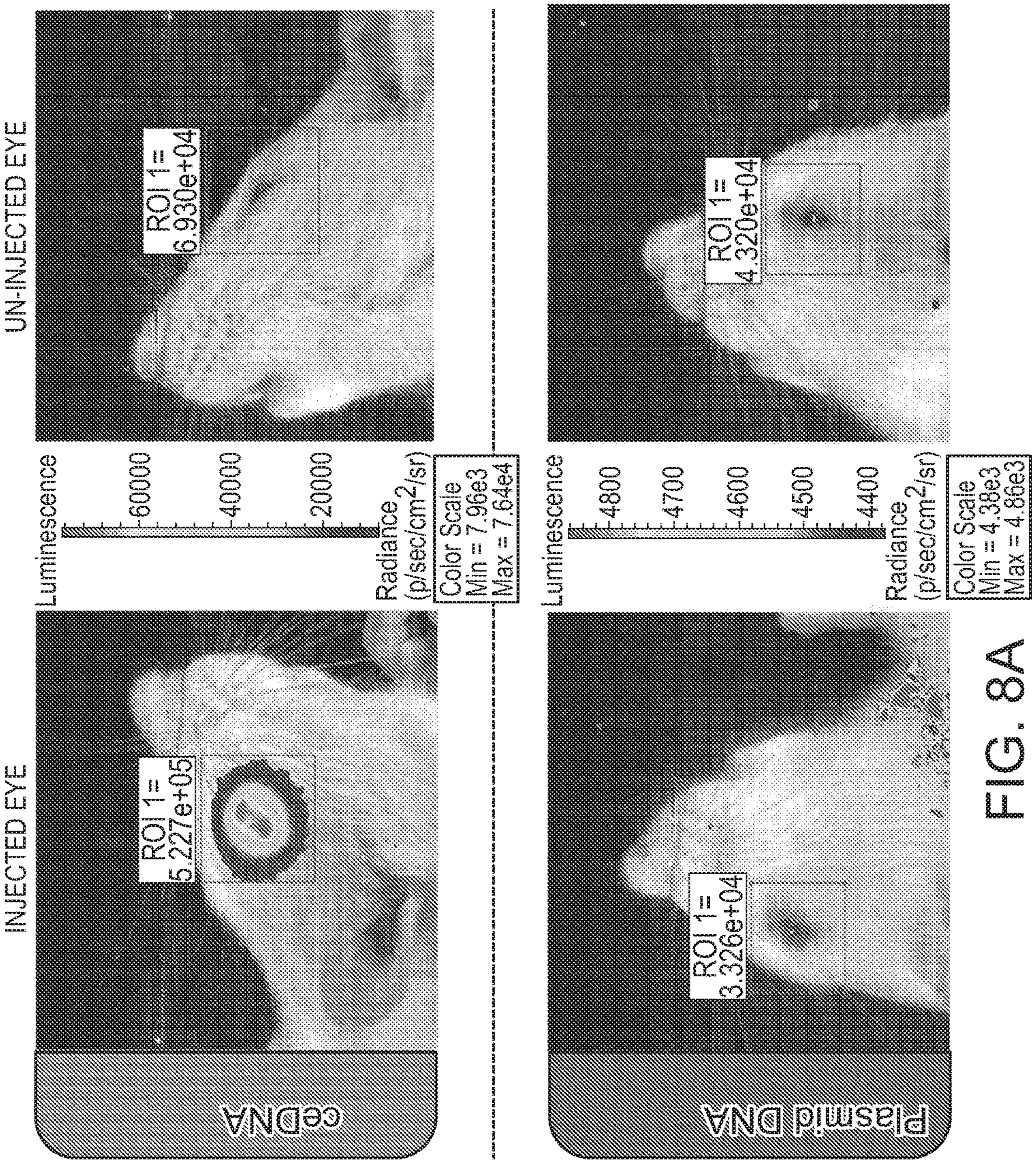
FIGS. 8A and 8B depict the results of the ocular studies set forth in Example 9.

A "Rep-plasmid" as disclosed in FIG. 8A of PCT/US18/49996, which is incorporated herein in its entirety by reference, was produced in a pFASTBAC™-Dual expression vector (ThermoFisher) comprising both the Rep78 (SEQ ID NO: 131 or 133) and Rep52 (SEQ ID NO: 132) or Rep68 (SEQ ID NO: 130) and Rep40 (SEQ ID NO: 129). The Rep-plasmid was transformed into the DH10Bac competent cells (MAX EFFICIENCY® DH10Bac™ Competent Cells (Thermo Fisher) following a protocol provided by the manufacturer. Recombination between the Rep-plasmid and a baculovirus shuttle vector in the DH10Bac cells were induced to generate recombinant bacmids ("Rep-bacmids"). The recombinant bacmids were selected by a positive selection that included-blue-white screening in *E. coli* (Φ80dlacZΔM15 marker provides α-complementation of the β-galactosidase gene from the bacmid vector) on a bacterial agar plate containing X-gal and IPTG. Isolated white colonies were picked and inoculated in 10 ml of selection media (kanamycin, gentamicin, tetracycline in LB broth). The recombinant bacmids (Rep-bacmids) were isolated from the *E. coli* and the Rep-bacmids were transfected into Sf9 or Sf21 insect cells to produce infectious baculovirus.

The Sf9 or Sf21 insect cells were cultured in 50 ml of media for 4 days, and infectious recombinant baculovirus ("Rep-baculovirus") were isolated from the culture. Optionally, the first generation Rep-baculovirus (P0) were amplified by infecting naïve Sf9 or Sf21 insect cells and cultured in 50 to 500 ml of media. Between 3 and 8 days post-infection, the P1 baculovirus particles in the medium were collected either by separating cells by centrifugation or filtration or another fractionation process. The Rep-baculovirus were collected and the infectious activity of the baculovirus was determined. Specifically, four×20 mL Sf9 cell cultures at $2.5\times10^6$ cells/mL were treated with P1 baculovirus at the following dilutions, 1/1000, 1/10,000, 1/50,000, 1/100,000, and incubated. Infectivity was determined by the rate of cell diameter increase and cell cycle arrest, and change in cell viability every day for 4 to 5 days.

ceDNA Vector Generation and Characterization

With reference to FIG. 4B, Sf9 insect cell culture media containing either (1) a sample-containing a ceDNA-bacmid or a ceDNA-baculovirus, and (2) Rep-baculovirus described above were then added to a fresh culture of Sf9 cells (2.5E+6 cells/ml, 20 ml) at a ratio of 1:1000 and 1:10,000, respectively. The cells were then cultured at 130 rpm at 25° C. 4-5 days after the co-infection, cell diameter and viability are detected. When cell diameters reached 18-20 nm with a viability of ~70-80%, the cell cultures were centrifuged, the medium was removed, and the cell pellets were collected. The cell pellets are first resuspended in an adequate volume of aqueous medium, either water or buffer. The ceDNA vector was isolated and purified from the cells using Qiagen MIDI PLUS™ purification protocol (Qiagen, 0.2 mg of cell pellet mass processed per column).

Yields of ceDNA vectors produced and purified from the Sf9 insect cells were initially determined based on UV absorbance at 260 nm.

ceDNA vectors can be assessed by identified by agarose gel electrophoresis under native or denaturing conditions as illustrated in FIG. 4D, where (a) the presence of characteristic bands migrating at twice the size on denaturing gels versus native gels after restriction endonuclease cleavage and gel electrophoretic analysis and (b) the presence of monomer and dimer (2×) bands on denaturing gels for uncleaved material is characteristic of the presence of ceDNA vector.

Figure 4E:
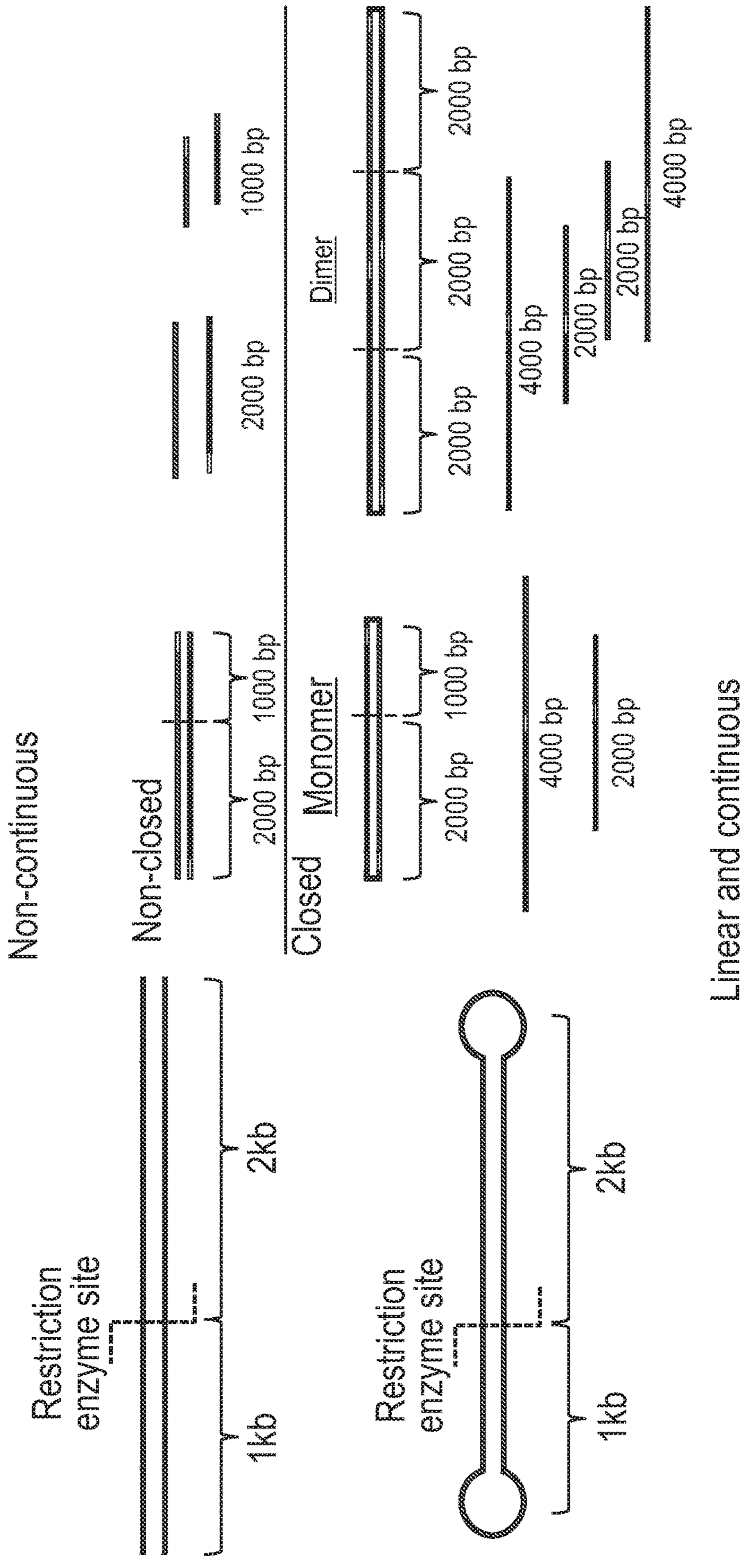

Structures of the isolated ceDNA vectors were further analyzed by digesting the DNA obtained from co-infected Sf9 cells (as described herein) with restriction endonucleases selected for a) the presence of only a single cut site within the ceDNA vectors, and b) resulting fragments that were large enough to be seen clearly when fractionated on a 0.8% denaturing agarose gel (>800 bp). As illustrated in FIGS. 4D and 4E, linear DNA vectors with a non-continuous structure and ceDNA vector with the linear and continuous structure can be distinguished by sizes of their reaction products—for example, a DNA vector with a non-continuous structure is expected to produce 1 kb and 2 kb fragments, while a non-encapsidated vector with the continuous structure is expected to produce 2 kb and 4 kb fragments.

Therefore, to demonstrate in a qualitative fashion that isolated ceDNA vectors are covalently closed-ended as is required by definition, the samples were digested with a restriction endonuclease identified in the context of the specific DNA vector sequence as having a single restriction site, preferably resulting in two cleavage products of unequal size (e.g., 1000 bp and 2000 bp). Following digestion and electrophoresis on a denaturing gel (which separates the two complementary DNA strands), a linear, non-covalently closed DNA will resolve at sizes 1000 bp and 2000 bp, while a covalently closed DNA (i.e., a ceDNA vector) will resolve at 2× sizes (2000 bp and 4000 bp), as the two DNA strands are linked and are now unfolded and twice the length (though single stranded). Furthermore, digestion of monomeric, dimeric, and n-meric forms of the DNA vectors will all resolve as the same size fragments due to the end-to-end linking of the multimeric DNA vectors (see FIG. 4D).

As used herein, the phrase "assay for the Identification of DNA vectors by agarose gel electrophoresis under native gel and denaturing conditions" refers to an assay to assess the close-endedness of the ceDNA by performing restriction endonuclease digestion followed by electrophoretic assessment of the digest products. One such exemplary assay follows, though one of ordinary skill in the art will appreciate that many art-known variations on this example are possible. The restriction endonuclease is selected to be a single cut enzyme for the ceDNA vector of interest that will generate products of approximately 1/3× and 2/3× of the DNA vector length. This resolves the bands on both native and denaturing gels. Before denaturation, it is important to remove the buffer from the sample. The Qiagen PCR clean-up kit or desalting "spin columns," e.g. GE HEALTHCARE ILUSTRA™ MICROSPIN™ G-25 columns are some art-known options for the endonuclease digestion. The assay includes for example, i) digest DNA with appropriate restriction endonuclease(s), 2) apply to e.g., a Qiagen PCR clean-up kit, elute with distilled water, iii) adding 10× denaturing solution (10×=0.5 M NaOH, 10 mM EDTA), add 10× dye, not buffered, and analyzing, together with DNA ladders prepared by adding 10× denaturing solution to 4×, on a 0.8-1.0% gel previously incubated with 1 mM EDTA and 200 mM NaOH to ensure that the NaOH concentration is uniform in the gel and gel box, and running the gel in the presence of 1× denaturing solution (50 mM NaOH, 1 mM EDTA). One of ordinary skill in the art will appreciate what voltage to use to run the electrophoresis based on size and desired timing of results. After electrophoresis, the gels are drained and neutralized in 1×TBE or TAE and transferred to distilled water or 1×TBE/TAE with 1×SYBR Gold. Bands can then be visualized with e.g. Thermo Fisher, SYBR® Gold Nucleic Acid Gel Stain (10,000× Concentrate in DMSO) and epifluorescent light (blue) or UV (312 nm).

The purity of the generated ceDNA vector can be assessed using any art-known method. As one exemplary and non-limiting method, contribution of ceDNA-plasmid to the overall UV absorbance of a sample can be estimated by comparing the fluorescent intensity of ceDNA vector to a standard. For example, if based on UV absorbance 4 μg of ceDNA vector was loaded on the gel, and the ceDNA vector fluorescent intensity is equivalent to a 2 kb band which is known to be 1 μg, then there is 1 μg of ceDNA vector, and the ceDNA vector is 25% of the total UV absorbing material. Band intensity on the gel is then plotted against the calculated input that band represents—for example, if the total ceDNA vector is 8 kb, and the excised comparative band is 2 kb, then the band intensity would be plotted as 25% of the total input, which in this case would be 0.25 μg for 1.0 μg input. Using the ceDNA vector plasmid titration to plot a standard curve, a regression line equation is then used to calculate the quantity of the ceDNA vector band, which can then be used to determine the percent of total input represented by the ceDNA vector, or percent purity.

For comparative purposes, Example 1 describes the production of ceDNA vectors using an insect cell based method and a polynucleotide construct template, and is also described in Example 1 of PCT/US18/49996, which is incorporated herein in its entirety by reference. For example, a polynucleotide construct template used for generating the ceDNA vectors of the present invention according to Example 1 can be a ceDNA-plasmid, a ceDNA-Bacmid, and/or a ceDNA-baculovirus. Without being limited to theory, in a permissive host cell, in the presence of e.g., Rep, the polynucleotide construct template having two symmetric ITRs and an expression construct, where at least one of the ITRs is modified relative to a wild-type ITR sequence, replicates to produce ceDNA vectors. ceDNA vector production undergoes two steps: first, excision ("rescue") of template from the template backbone (e.g. ceDNA-plasmid, ceDNA-bacmid, ceDNA-baculovirus genome etc.) via Rep proteins, and second, Rep mediated replication of the excised ceDNA vector.

An exemplary method to produce ceDNA vectors in a method using insect cell is from a ceDNA-plasmid as described herein. Referring to FIGS. 1A and 1B, the polynucleotide construct template of each of the ceDNA-plasmids includes both a left modified ITR and a right modified ITR with the following between the ITR sequences: (i) an enhancer/promoter; (ii) a cloning site for a transgene; (iii) a posttranscriptional response element (e.g. the woodchuck hepatitis virus posttranscriptional regulatory element (WPRE)); and (iv) a poly-adenylation signal (e.g. from bovine growth hormone gene (BGHpA). Unique restriction endonuclease recognition sites (R1-R6) (shown in FIG. 1A and FIG. 1B) were also introduced between each component to facilitate the introduction of new genetic components into the specific sites in the construct. R3 (PmeI) GTTTAAAC (SEQ ID NO: 123) and R4 (Pad) TTAATTAA (SEQ ID NO: 124) enzyme sites are engineered into the cloning site to introduce an open reading frame of a transgene. These sequences were cloned into a pFastBac HT B plasmid obtained from ThermoFisher Scientific.

Example 2: Synthetic ceDNA Production Via Excision from a Double-Stranded DNA Molecule Synthetic production of the ceDNA vectors is described in Examples 2-6 of International Application PCT/US19/

Figure 6:
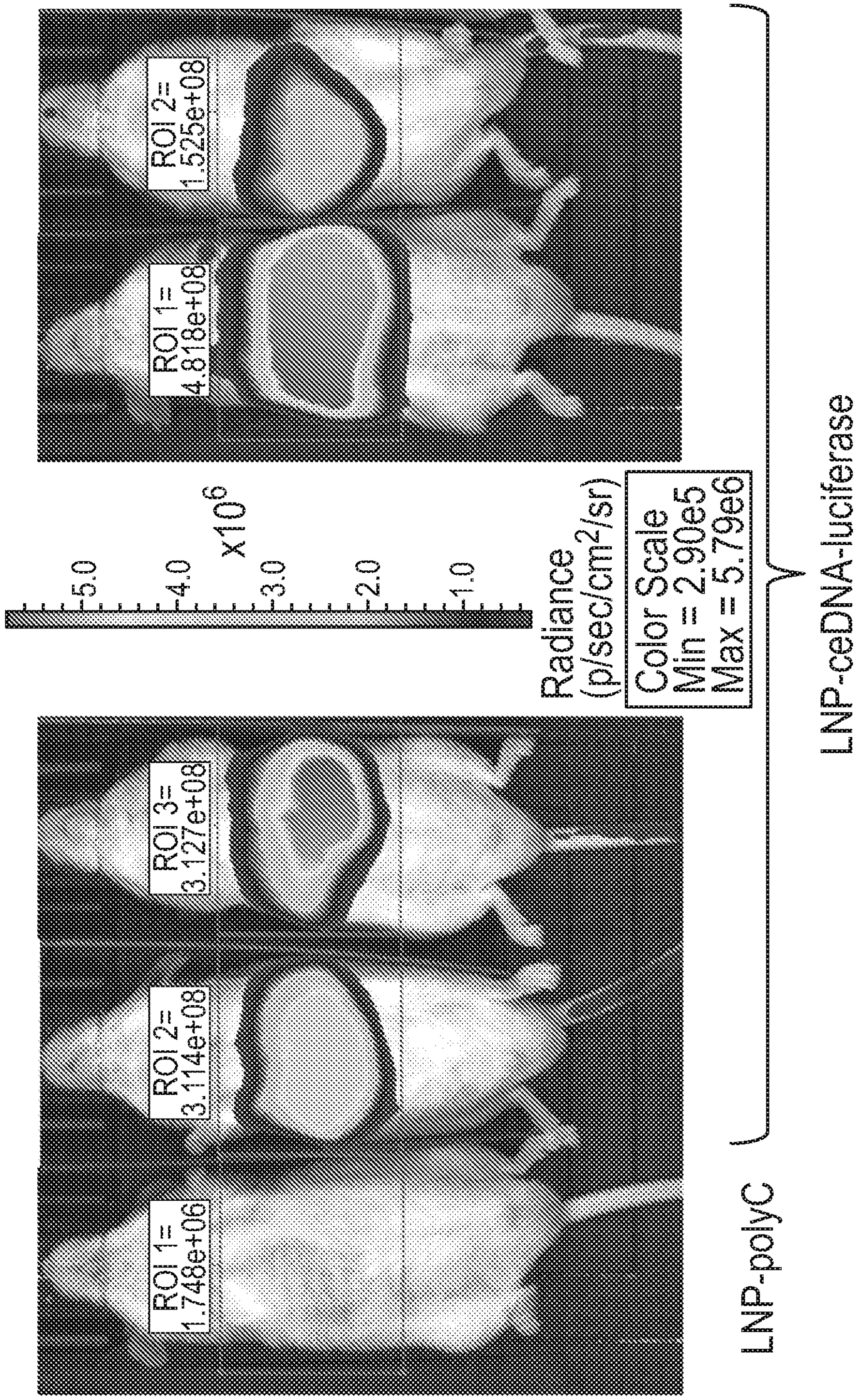
FIG. 6 depicts the results of the experiments described in Example 7 and specifically shows the IVIS images obtained from mice treated with LNP-polyC control (mouse furthest to the left) and four mice treated with LNP-ceDNA-Luciferase (all but the mouse furthest to the left). The four ceDNA-treated mice show significant fluorescence in the liver-containing region of the mouse.

14122, filed Jan. 18, 2019, which is incorporated herein in its entirety by reference. One exemplary method of producing a ceDNA vector using a synthetic method that involves the excision of a double-stranded DNA molecule. In brief, a ceDNA vector can be generated using a double stranded DNA construct, e.g., see FIGS. 7A-8E of PCT/US19/14122. In some embodiments, the double stranded DNA construct is a ceDNA plasmid, e.g., see, e.g., FIG. 6 in International patent application PCT/US2018/064242, filed Dec. 6, 2018).

In some embodiments, a construct to make a ceDNA vector comprises a regulatory switch as described herein.

For illustrative purposes, Example 2 describes producing ceDNA vectors as exemplary closed-ended DNA vectors generated using this method. However, while ceDNA vectors are exemplified in this Example to illustrate in vitro synthetic production methods to generate a closed-ended DNA vector by excision of a double-stranded polynucleotide comprising the ITRs and expression cassette (e.g., heterologous nucleic acid sequence) followed by ligation of the free 3' and 5' ends as described herein, one of ordinary skill in the art is aware that one can, as illustrated above, modify the double stranded DNA polynucleotide molecule such that any desired closed-ended DNA vector is generated, including but not limited to, doggybone DNA, dumbbell DNA and the like. Exemplary ceDNA vectors for production of antibodies or fusion proteins that can be produced by the synthetic production method described in Example 2 are discussed in the sections entitled "III ceDNA vectors in general". Exemplary antibodies and fusion proteins expressed by the ceDNA vectors are described in the section entitled "IIC Exemplary antibodies and fusion proteins expressed by the ceDNA vectors".

The method involves (i) excising a sequence encoding the expression cassette from a double-stranded DNA construct and (ii) forming hairpin structures at one or more of the ITRs and (iii) joining the free 5' and 3' ends by ligation, e.g., by T4 DNA ligase.

The double-stranded DNA construct comprises, in 5' to 3' order: a first restriction endonuclease site; an upstream ITR; an expression cassette; a downstream ITR; and a second restriction endonuclease site. The double-stranded DNA construct is then contacted with one or more restriction endonucleases to generate double-stranded breaks at both of the restriction endonuclease sites. One endonuclease can target both sites, or each site can be targeted by a different endonuclease as long as the restriction sites are not present in the ceDNA vector template. This excises the sequence between the restriction endonuclease sites from the rest of the double-stranded DNA construct (see FIG. 9 of PCT/US19/14122). Upon ligation a closed-ended DNA vector is formed.

Figure 10:
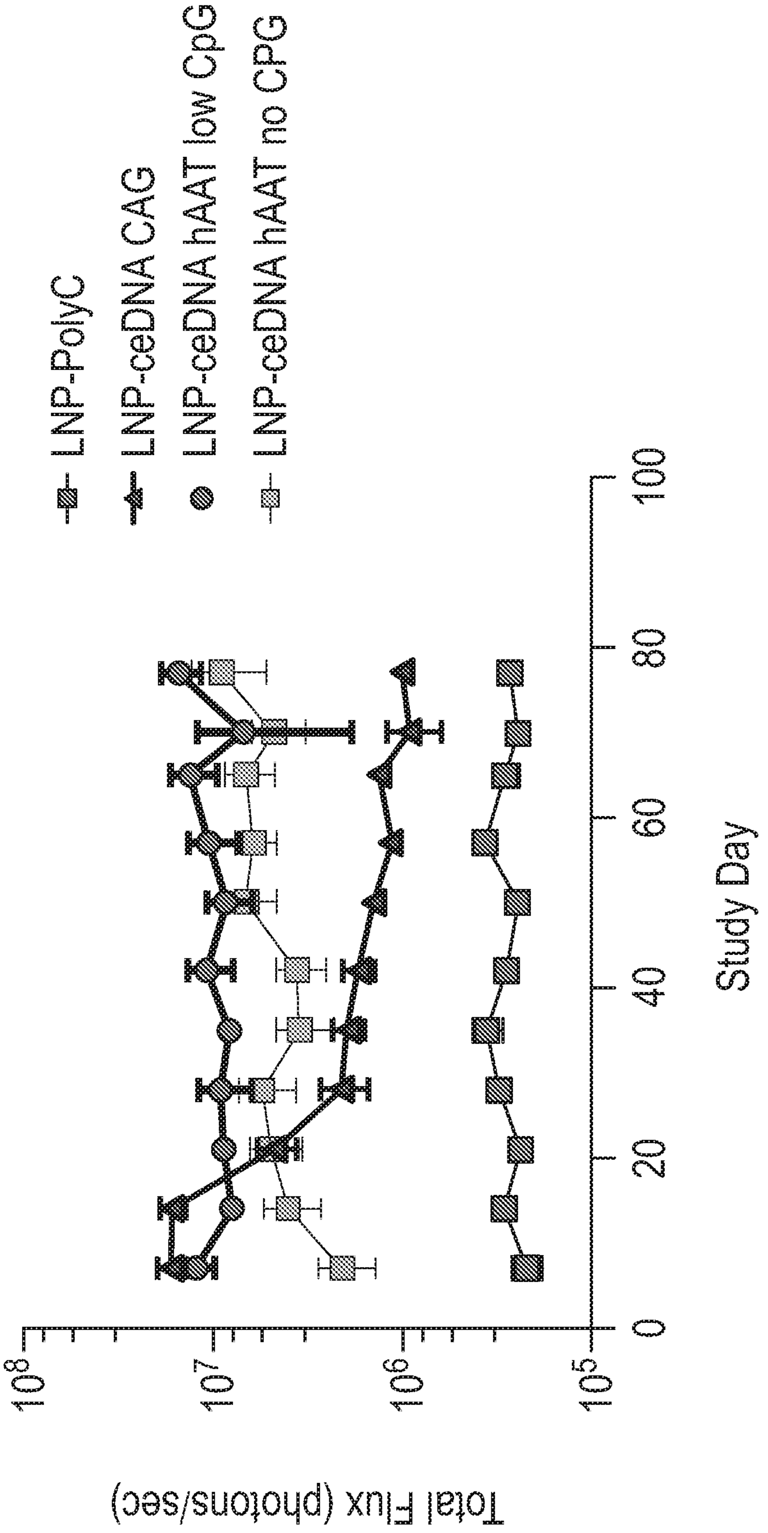
FIG. 10 provides data from the ceDNA luciferase expression study in treated mice described in Example 11, showing total flux in each group of mice over the duration of the study. High levels of unmethylated CpG correlated with lower total flux observed in the mice over time, while use of a liver-specific promoter correlated with durable, stable expression of the transgene from the ceDNA vector over at least 77 days.

One or both of the ITRs used in the method may be wild-type ITRs. Modified ITRs may also be used, where the modification can include deletion, insertion, or substitution of one or more nucleotides from the wild-type ITR in the sequences forming B and B' arm and/or C and C' arm (see, e.g., FIGS. 6-8 and 10 FIG. 11B of PCT/US19/14122), and may have two or more hairpin loops (see, e.g., FIGS. 6-8 FIG. 11B of PCT/US19/14122) or a single hairpin loop (see, e.g., FIG. 10A-10B FIG. 11B of PCT/US19/14122). The hairpin loop modified ITR can be generated by genetic modification of an existing oligo or by de novo biological and/or chemical synthesis.

In a non-limiting example, ITR-6 Left and Right (SEQ ID NOS: 111 and 112), include 40 nucleotide deletions in the B-B' and C-C' arms from the wild-type ITR of AAV2. Nucleotides remaining in the modified ITR are predicted to form a single hairpin structure. Gibbs free energy of unfolding the structure is about −54.4 kcal/mol. Other modifications to the ITR may also be made, including optional deletion of a functional Rep binding site or a TRS site.

Example 3: ceDNA Production Via Oligonucleotide Construction

Another exemplary method of producing a ceDNA vector using a synthetic method that involves assembly of various oligonucleotides, is provided in Example 3 of PCT/US19/14122, where a ceDNA vector is produced by synthesizing a 5' oligonucleotide and a 3' ITR oligonucleotide and ligating the ITR oligonucleotides to a double-stranded polynucleotide comprising an expression cassette. FIG. 11B of PCT/US19/14122 shows an exemplary method of ligating a 5' ITR oligonucleotide and a 3' ITR oligonucleotide to a double stranded polynucleotide comprising an expression cassette.

Figure 3C:
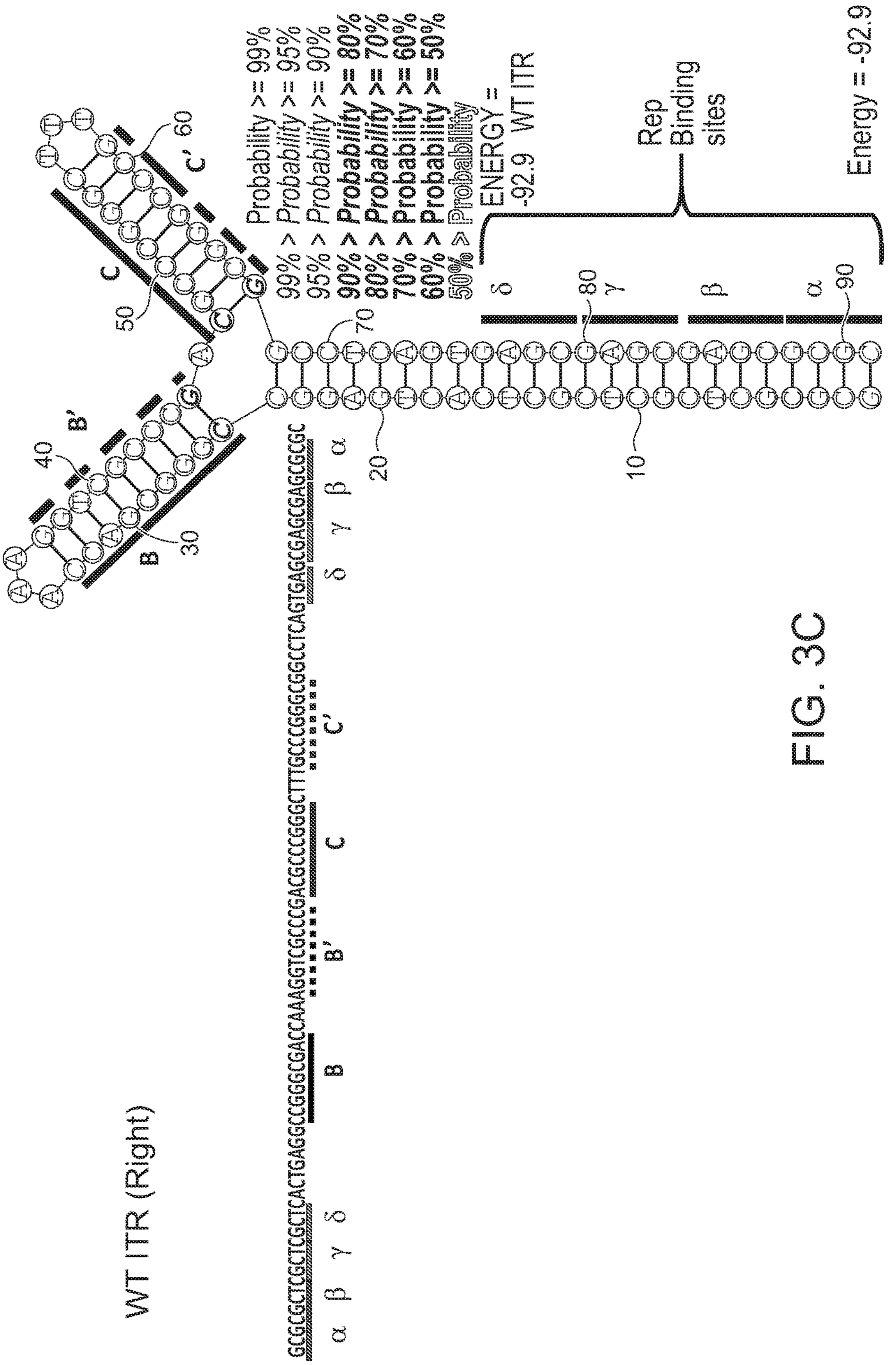
FIG. 3C shows the primary structure (left) and the secondary structure (right) of the RBE-containing portion of the A-A' loop, and the B-B' and C-C' arms of wild type right AAV2 ITR (SEQ ID NO: 55).
Figure 3D:
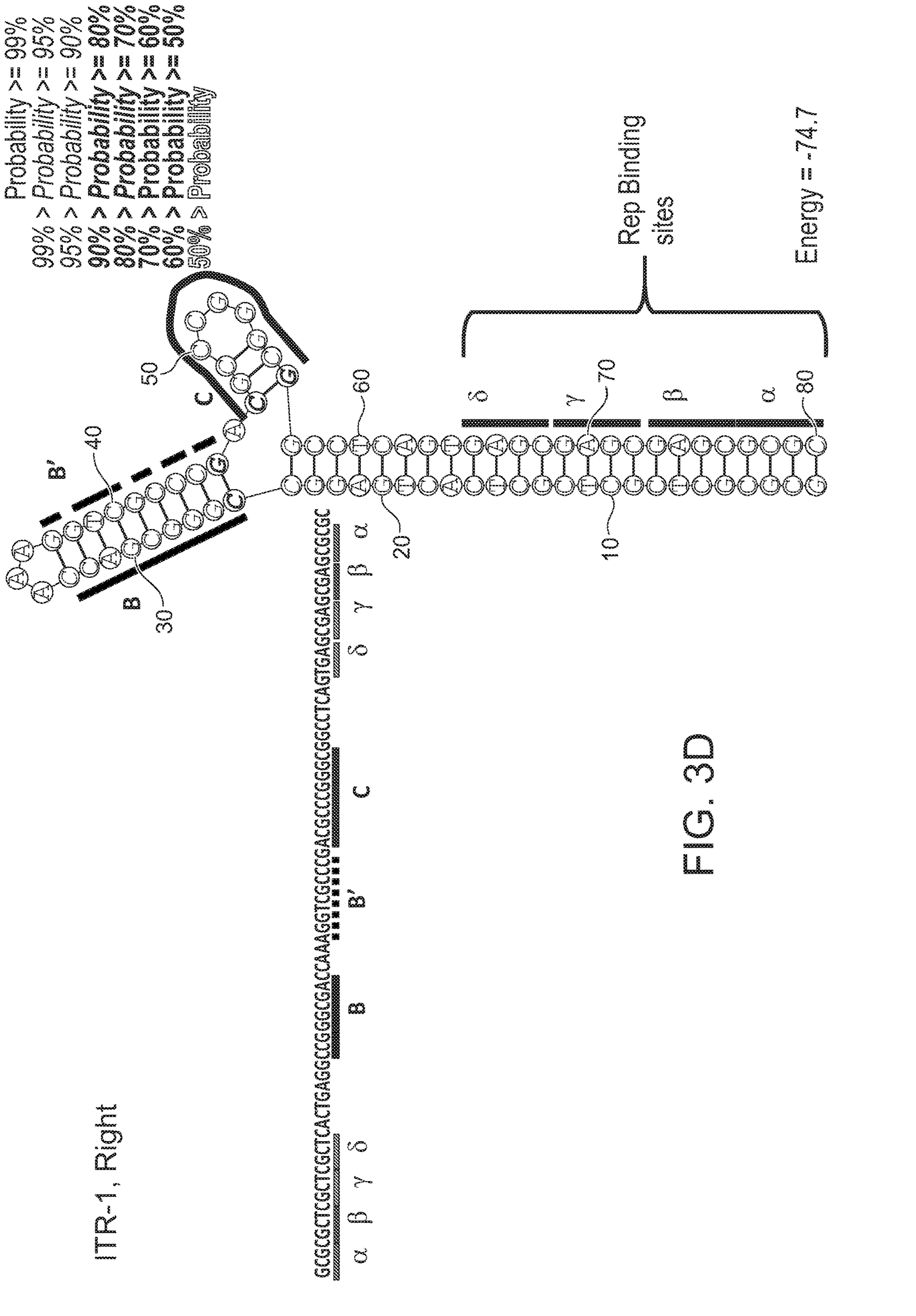
FIG. 3D shows an exemplary right modified ITR. Shown is the primary structure (left) and the predicted secondary structure (right) of the RBE containing portion of the A-A' arm, the B-B' and the C arm of an exemplary mutant right ITR (ITR-1, right) (SEQ ID NO: 114). Any combination of left and right ITR (e.g., AAV2 ITRs or other viral serotype or synthetic ITRs) can be used as taught herein. Each of FIGS. 3A-3D polynucleotide sequences refer to the sequence used in the plasmid or bacmid/baculovirus genome used to produce the ceDNA as described herein. Also included in each of FIGS. 3A-3D are corresponding ceDNA secondary structures inferred from the ceDNA vector configurations in the plasmid or bacmid/baculovirus genome and the predicted Gibbs free energy values.

As disclosed herein, the ITR oligonucleotides can comprise WT-ITRs (e.g., see FIG. 3A, FIG. 3C), or modified ITRs (e.g., see, FIG. 3B and FIG. 3D). (See also, e.g., FIGS. 6A, 6B, 7A and 7B of PCT/US19/14122, which is incorporated herein in its entirety). Exemplary ITR oligonucleotides include, but are not limited to SEQ ID NOS: 134-145 (e.g., see Table 7 in of PCT/US19/14122). Modified ITRs can include deletion, insertion, or substitution of one or more nucleotides from the wild-type ITR in the sequences forming B and B' arm and/or C and C' arm. ITR oligonucleotides, comprising WT-ITRs or mod-ITRs as described herein, to be used in the cell-free synthesis, can be generated by genetic modification or biological and/or chemical synthesis. As discussed herein, the ITR oligonucleotides in Examples 2 and 3 can comprise WT-ITRs, or modified ITRs (mod-ITRs) in symmetrical or asymmetrical configurations, as discussed herein.

Example 4: ceDNA Production Via a Single-Stranded DNA Molecule

Another exemplary method of producing a ceDNA vector using a synthetic method is provided in Example 4 of PCT/US19/14122, and uses a single-stranded linear DNA comprising two sense ITRs which flank a sense expression cassette sequence and are attached covalently to two antisense ITRs which flank an antisense expression cassette, the ends of which single stranded linear DNA are then ligated to form a closed-ended single-stranded molecule. One non-limiting example comprises synthesizing and/or producing a single-stranded DNA molecule, annealing portions of the molecule to form a single linear DNA molecule which has one or more base-paired regions of secondary structure, and then ligating the free 5' and 3' ends to each other to form a closed single-stranded molecule.

An exemplary single-stranded DNA molecule for production of a ceDNA vector comprises, from 5' to 3': a sense first ITR; a sense expression cassette sequence; a sense second ITR; an antisense second ITR; an antisense expression cassette sequence; and an antisense first ITR.

A single-stranded DNA molecule for use in the exemplary method of Example 4 can be formed by any DNA synthesis methodology described herein, e.g., in vitro DNA synthesis, or provided by cleaving a DNA construct (e.g., a plasmid) with nucleases and melting the resulting dsDNA fragments to provide ssDNA fragments.

Annealing can be accomplished by lowering the temperature below the calculated melting temperatures of the sense and antisense sequence pairs. The melting temperature is dependent upon the specific nucleotide base content and the characteristics of the solution being used, e.g., the salt concentration. Melting temperatures for any given sequence and solution combination are readily calculated by one of ordinary skill in the art.

The free 5' and 3' ends of the annealed molecule can be ligated to each other, or ligated to a hairpin molecule to form the ceDNA vector. Suitable exemplary ligation methodologies and hairpin molecules are described in Examples 2 and 3.

Example 5: Purifying and/or Confirming Production of ceDNA

Any of the DNA vector products produced by the methods described herein, e.g., including the insect cell based production methods described in Example 1, or synthetic production methods described in Examples 2-4 can be purified, e.g., to remove impurities, unused components, or byproducts using methods commonly known by a skilled artisan; and/or can be analyzed to confirm that DNA vector produced, (in this instance, a ceDNA vector) is the desired molecule. An exemplary method for purification of the DNA vector, e.g., ceDNA is using Qiagen Midi Plus purification protocol (Qiagen) and/or by gel purification, The following is an exemplary method for confirming the identity of ceDNA vectors.

ceDNA vectors can be assessed by identified by agarose gel electrophoresis under native or denaturing conditions as illustrated in FIG. 4D, where (a) the presence of characteristic bands migrating at twice the size on denaturing gels versus native gels after restriction endonuclease cleavage and gel electrophoretic analysis and (b) the presence of monomer and dimer (2×) bands on denaturing gels for uncleaved material is characteristic of the presence of ceDNA vector.

Structures of the isolated ceDNA vectors were further analyzed by digesting the purified DNA with restriction endonucleases selected for a) the presence of only a single cut site within the ceDNA vectors, and b) resulting fragments that were large enough to be seen clearly when fractionated on a 0.8% denaturing agarose gel (>800 bp). As illustrated in FIGS. 4C and 4D, linear DNA vectors with a non-continuous structure and ceDNA vector with the linear and continuous structure can be distinguished by sizes of their reaction products—for example, a DNA vector with a non-continuous structure is expected to produce 1 kb and 2 kb fragments, while a ceDNA vector with the continuous structure is expected to produce 2 kb and 4 kb fragments.

Therefore, to demonstrate in a qualitative fashion that isolated ceDNA vectors are covalently closed-ended as is required by definition, the samples were digested with a restriction endonuclease identified in the context of the specific DNA vector sequence as having a single restriction site, preferably resulting in two cleavage products of unequal size (e.g., 1000 bp and 2000 bp). Following digestion and electrophoresis on a denaturing gel (which separates the two complementary DNA strands), a linear, non-covalently closed DNA will resolve at sizes 1000 bp and 2000 bp, while a covalently closed DNA (i.e., a ceDNA vector) will resolve at 2× sizes (2000 bp and 4000 bp), as the two DNA strands are linked and are now unfolded and twice the length (though single stranded). Furthermore, digestion of monomeric, dimeric, and n-meric forms of the DNA vectors will all resolve as the same size fragments due to the end-to-end linking of the multimeric DNA vectors (see FIG. 4E).

As used herein, the phrase "assay for the Identification of DNA vectors by agarose gel electrophoresis under native gel and denaturing conditions" refers to an assay to assess the close-endedness of the ceDNA by performing restriction endonuclease digestion followed by electrophoretic assessment of the digest products. One such exemplary assay follows, though one of ordinary skill in the art will appreciate that many art-known variations on this example are possible. The restriction endonuclease is selected to be a single cut enzyme for the ceDNA vector of interest that will generate products of approximately ⅓× and ⅔× of the DNA vector length. This resolves the bands on both native and denaturing gels. Before denaturation, it is important to remove the buffer from the sample. The Qiagen PCR clean-up kit or desalting "spin columns," e.g. GE HEALTHCARE ILUSTRA™ MICROSPIN™ G-25 columns are some art-known options for the endonuclease digestion. The assay includes for example, i) digest DNA with appropriate restriction endonuclease(s), 2) apply to e.g., a Qiagen PCR clean-up kit, elute with distilled water, iii) adding 10× denaturing solution (10×=0.5 M NaOH, 10 mM EDTA), add 10× dye, not buffered, and analyzing, together with DNA ladders prepared by adding 10× denaturing solution to 4×, on a 0.8-1.0% gel previously incubated with 1 mM EDTA and 200 mM NaOH to ensure that the NaOH concentration is uniform in the gel and gel box, and running the gel in the presence of 1× denaturing solution (50 mM NaOH, 1 mM EDTA). One of ordinary skill in the art will appreciate what voltage to use to run the electrophoresis based on size and desired timing of results. After electrophoresis, the gels are drained and neutralized in 1×TBE or TAE and transferred to distilled water or 1×TBE/TAE with 1×SYBR Gold. Bands can then be visualized with e.g. Thermo Fisher, SYBR® Gold Nucleic Acid Gel Stain (10,000× Concentrate in DMSO) and epifluorescent light (blue) or UV (312 nm). The foregoing gel-based method can be adapted to purification purposes by isolating the ceDNA vector from the gel band and permitting it to renature.

The purity of the generated ceDNA vector can be assessed using any art-known method. As one exemplary and non-limiting method, contribution of ceDNA-plasmid to the overall UV absorbance of a sample can be estimated by comparing the fluorescent intensity of ceDNA vector to a standard. For example, if based on UV absorbance 4 μg of ceDNA vector was loaded on the gel, and the ceDNA vector fluorescent intensity is equivalent to a 2 kb band which is known to be 1 μg, then there is 1 μg of ceDNA vector, and the ceDNA vector is 25% of the total UV absorbing material. Band intensity on the gel is then plotted against the calculated input that band represents—for example, if the total ceDNA vector is 8 kb, and the excised comparative band is 2 kb, then the band intensity would be plotted as 25% of the total input, which in this case would be 0.25 μg for 1.0 μg input. Using the ceDNA vector plasmid titration to plot a standard curve, a regression line equation is then used to calculate the quantity of the ceDNA vector band, which can then be used to determine the percent of total input represented by the ceDNA vector, or percent purity.

Example 6: Controlled Transgene Expression from ceDNA: Transgene Expression from the ceDNA Vector In Vivo can be Sustained and/or Increased by Re-Dose Administration A ceDNA vector was produced according to the methods described in Example 1 above, using a ceDNA plasmid comprising a CAG promoter (SEQ ID NO: 72) and a luciferase transgene (SEQ ID NO: 56) as an exemplary FVIII, flanked between asymmetric ITRs (e.g., a 5' WT-ITR (SEQ ID NO: 2) and a 3' mod-ITR (SEQ ID NO: 3) and was assessed in different treatment programs in vivo. This ceDNA vector was used in all subsequent experiments described in Examples 6-10. In Example 6, the ceDNA vector was purified and formulated with a lipid nanoparticle (LNP ceDNA) and injected into the tail vein of each CD-1® IGS mice. Liposomes were formulated with a suitable lipid blend comprising four components to form lipid nanoparticles (LNP) liposomes, including cationic lipids, helper lipids, cholesterol and PEG-lipids.

To assess the sustained expression of the transgene in vivo from the ceDNA vector over a long time period, the LNP-ceDNA was administered in sterile PBS by tail vein intravenous injection to CD-1® IGS mice of approximately 5-7 weeks of age. Three different dosage groups were assessed: 0.1 mg/kg, 0.5 mg/kg, and 1.0 mg/kg, ten mice per group (except 1.0 mg/kg which had 15 mice per group). Injections were administered on day 0. Five mice from each of the groups were injected with an additional identical dose on day 28. Luciferase expression was measured by IVIS imaging following intravenous administration into CD-1® IGS mice (Charles River Laboratories; WT mice). Luciferase expression was assessed by IVIS imaging following intraperitoneal injection of 150 mg/kg luciferin substrate on days 3, 4, 7, 14, 21, 28, 31, 35, and 42, and routinely (e.g., weekly, biweekly or every 10-days or every 2 weeks), between days 42-110 days. Luciferase transgene expression as the exemplary FVIII as measured by IVIS imaging for at least 132 days after 3 different administration protocols (data not shown).

An extension study was performed to investigate the effect of a re-dose, e.g., a re-administration of LNP-ceDNA expressing luciferase of the LNP-ceDNA treated subjects. In particular, it was assessed to determine if expression levels can be increased by one or more additional administrations of the ceDNA vector.

In this study, the biodistribution of luciferase expression from a ceDNA vector was assessed by IVIS in CD-1® IGS mice after an initial intravenous administration of 1.0 mg/kg (i.e., a priming dose) at days 0 and 28 (Group A). A second administration of a ceDNA vector was administered via tail vein injection of 3 mg/kg (Group B) or 10 mg/kg (Group C) in 1.2 mL in the tail vein at day 84. In this study, five (5) CD-1® mice were used in each of Groups A, B and C. IVIS imaging of the mice for luciferase expression was performed prior to the additional dosing at days 49, 56, 63, and 70 as described above, as well as post-redose on day 84 and on days 91, 98, 105, 112, and 132. Luciferase expression was assessed and detected in all three Groups A, B and C until at least 110 days (the longest time period assessed).

The level of expression of luciferase was shown to be increased by a re-dose (i.e., re-administration of the ceDNA composition) of the LNP-ceDNA-Luc, as determined by assessment of luciferase activity in the presence of luciferin. Luciferase transgene expression as an exemplary FVIII as measured by IVIS imaging for at least 110 days after 3 different administration protocols (Groups A, B and C). The mice that had not been given any additional redose (1 mg/kg priming dose (i.e., Group A) treatment had stable luciferase expression observed over the duration of the study. The mice in Group B that had been administered a re-dose of 3 mg/kg of the ceDNA vector showed an approximately seven-fold increase in observed radiance relative to the mice in Group C. Surprisingly, the mice re-dosed with 10 mg/kg of the ceDNA vector had a 17-fold increase in observed luciferase radiance over the mice not receiving any redose (Group A).

Group A shows luciferase expression in CD-1® IGS mice after intravenous administration of 1 mg/kg of a ceDNA vector into the tail vein at days 0 and 28. Group B and C show luciferase expression in CD-1® IGS mice administered 1 mg/kg of a ceDNA vector at a first time point (day 0) and re-dosed with administration of a ceDNA vector at a second time point of 84 days. The second administration (i.e., re-dose) of the ceDNA vector increased expression by at least 7-fold, even up to 17-fold.

A 3-fold increase in the dose (i.e., the amount) of ceDNA vector in a re-dose administration in Group B (i.e., 3 mg/kg administered at re-dose) resulted in a 7-fold increase in expression of the luciferase. Also, unexpectedly, a 10-fold increase in the amount of ceDNA vector in a re-dose administration (i.e., 10 mg/kg re-dose administered) in Group C resulted in a 17-fold increase in expression of the luciferase. Thus, the second administration (i.e., re-dose) of the ceDNA increased expression by at least 7-fold, even up to 17-fold. This shows that the increase in transgene expression from the re-dose is greater than expected and dependent on the dose or amount of the ceDNA vector in the re-dose administration, and appears to be synergistic to the initial transgene expression from the initial priming administration at day 0. That is, the dose-dependent increase in transgene expression is not additive, rather, the expression level of the transgene is dose-dependent and greater than the sum of the amount of the ceDNA vector administered at each time point.

Both Groups B and C showed significant dose-dependent increase in expression of luciferase as compared to control mice (Group A) that were not re-dosed with a ceDNA vector at the second time point. Taken together, these data show that the expression of a transgene from ceDNA vector can be increased in a dose-dependent manner by re-dose (i.e., re-administration) of the ceDNA vector at least a second time point.

Taken together, these data demonstrate that the expression level of a transgene, e.g., FVIII from ceDNA vectors can be maintained at a sustained level for at least 84 days and can be increased in vivo after a redose of the ceDNA vector administered at least at a second time point.

Example 7: Sustained Transgene Expression In Vivo of LNP-Formulated ceDNA Vectors The reproducibility of the results in Example 6 with a different lipid nanoparticle was assessed in vivo in mice. Mice were dosed on day 0 with either ceDNA vector comprising a luciferase transgene driven by a CAG promoter that was encapsulated in an LNP different from that used in Example 6 or with that same LNP comprising polyC but lacking ceDNA or a luciferase gene. Specifically, male CD-1® mice of approximately 4 weeks of age were treated with a single injection of 0.5 mg/kg LNP-ceDNA-luciferase or control LNP-polyC, administered intravenously via lateral tail vein on day 0. At day 14 animals were dosed systemically with luciferin at 150 mg/kg via intraperitoneal injection at 2.5 mL/kg. At approximately 15 minutes after luciferin administration each animal was imaged using an In Vivo Imaging System ("IVIS").

Figure 7:
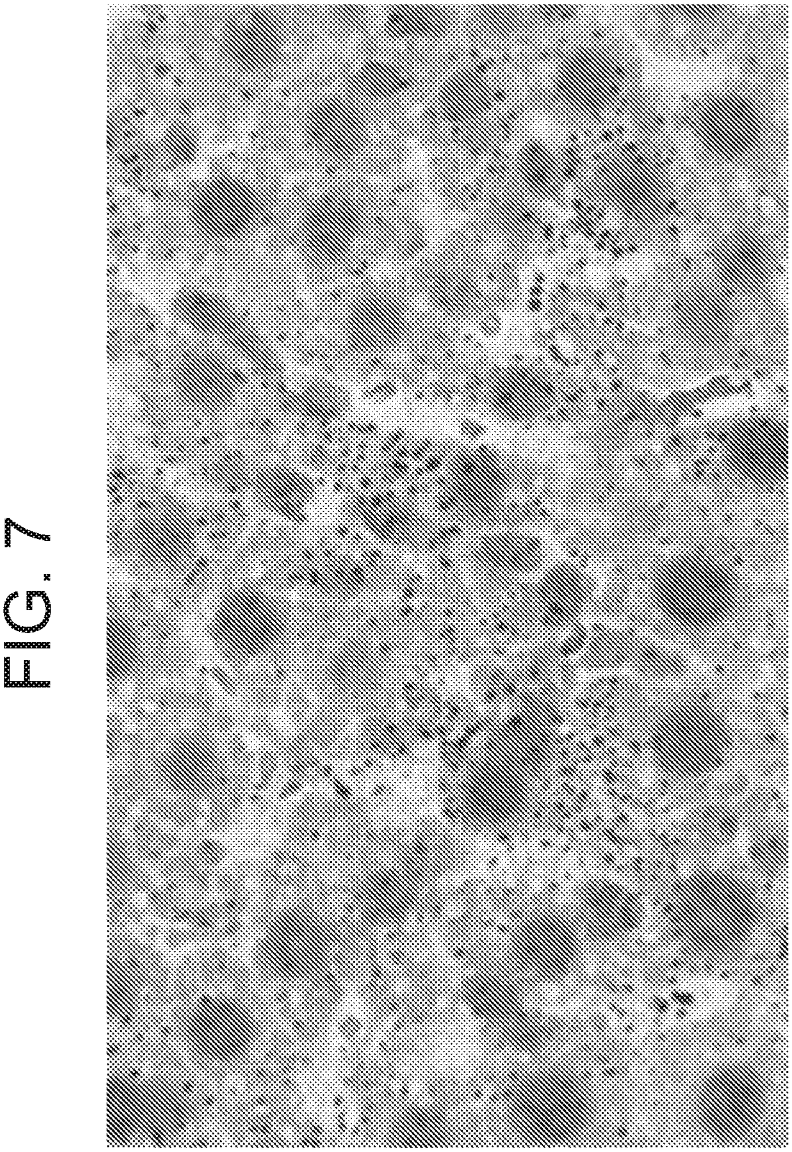
FIG. 7 depicts the results of the experiment described in Example 8. The dark specks indicate the presence of the protein resulting from the expressed ceDNA transgene and demonstrate association of the administered LNP-ceDNA with hepatocytes.

As shown in FIG. 7, significant fluorescence in the liver was observed in all four ceDNA-treated mice, and very little other fluorescence was observed in the animals other than at the injection site, indicating that the LNP mediated liver-specific delivery of the ceDNA construct and that the delivered ceDNA vector was capable of controlled sustained expression of its transgene for at least two weeks after administration.

Figure 8B:
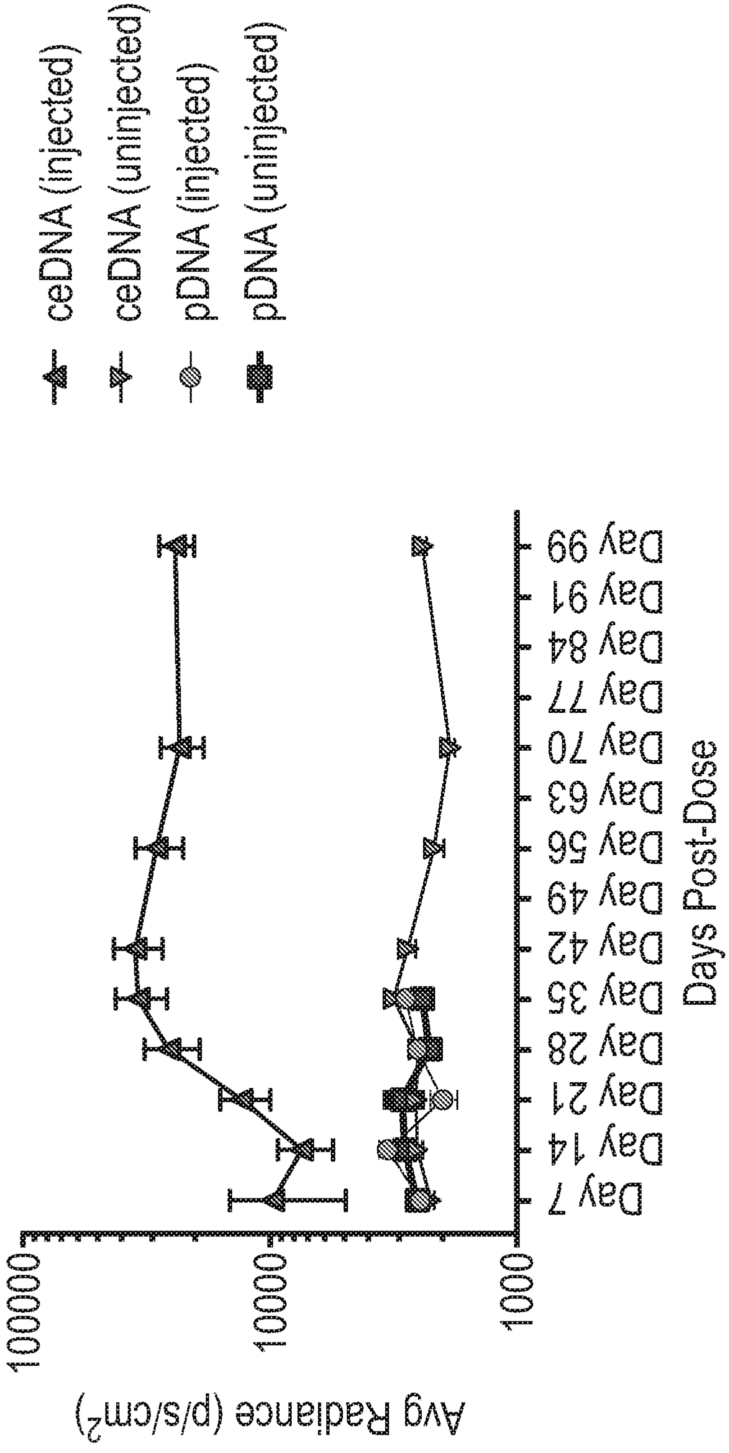

Example 8: Sustained Transgene Expression in the Liver In Vivo from ceDNA Vector Administration In a separate experiment, the localization of LNP-delivered ceDNA within the liver of treated animals was assessed. A ceDNA vector comprising a functional transgene of interest was encapsulated in the same LNP as used in Example 7 and administered to mice in vivo at a dose level of 0.5 mg/kg by intravenous injection. After 6 hours the mice were terminated and liver samples taken, formalin fixed and paraffin-embedded using standard protocols. RNAscope® in situ hybridization assays were performed to visualize the ceDNA vectors within the tissue using a probe specific for the ceDNA transgene and detecting using chromogenic reaction and hematoxylin staining (Advanced Cell Diagnostics). FIG. 8 shows the results, which indicate that ceDNA is present in hepatocytes.

Example 9: Sustained Ocular Transgene Expression of ceDNA In Vivo

The sustainability of ceDNA vector transgene expression in tissues other than the liver was assessed to determine tolerability and expression of a ceDNA vector after ocular administration in vivo. While luciferase was used as an exemplary transgene in Example 9, one of ordinary skill can readily substitute the luciferase transgene with an FVIII sequence from any of those listed in Table 1.

On day 0, male Sprague Dawley rats of approximately 9 weeks of age were injected sub-retinally with 5 μL of either ceDNA vector comprising a luciferase transgene formulated with jetPEI® transfection reagent (Polyplus) or plasmid DNA encoding luciferase formulated with jetPEI®, both at a concentration of 0.25 μg/μL. Four rats were tested in each group Animals were sedated and injected sub-retinally in the right eye with the test article using a 33-gauge needle. The left eye of each animal was untreated. Immediately after injection eyes were checked with optical coherence tomography or fundus imaging in order to confirm the presence of a subretinal bleb. Rats were treated with buprenorphine and topical antibiotic ointment according to standard procedures.

Figure 9B:
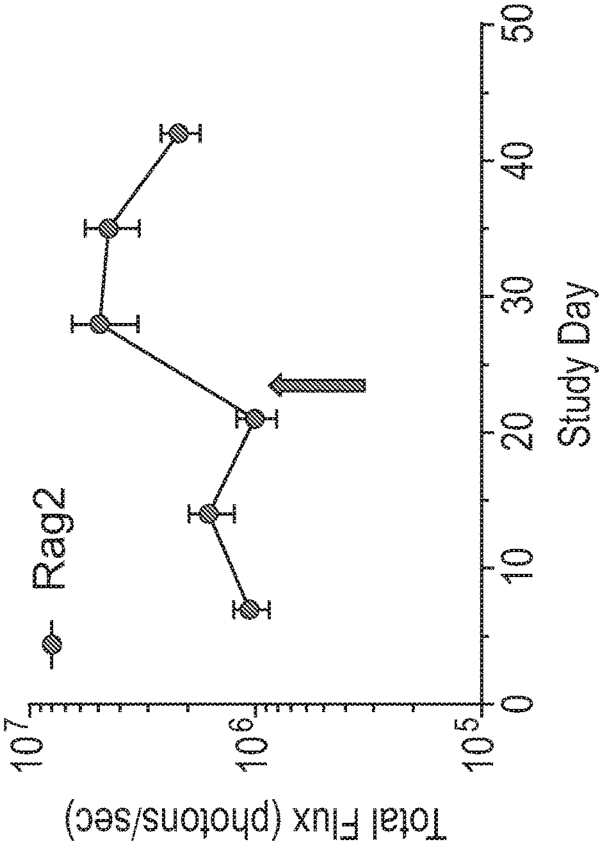
FIGS. 9A and 9B depict the results of the ceDNA persistence and redosing study in Rag2 mice described in Example 10.
Figure 9A:
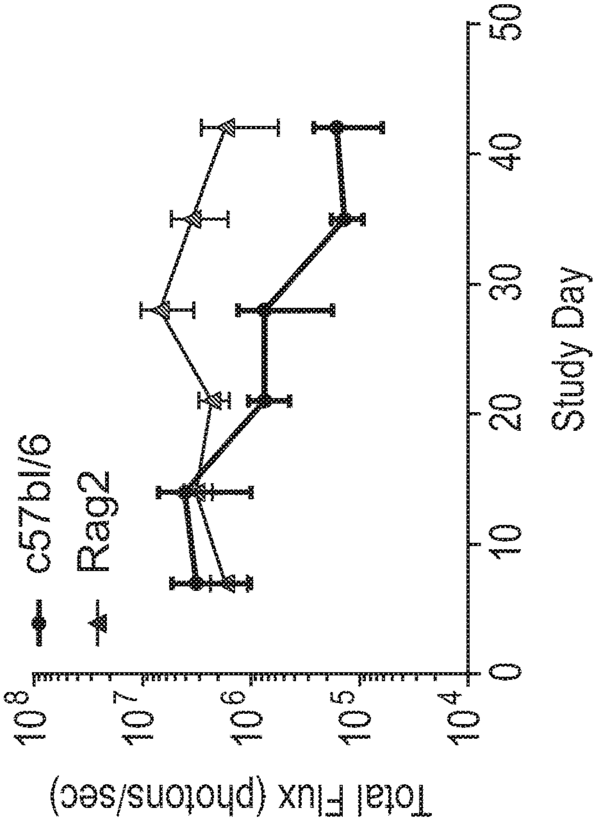

At days 7, 14, 21, 28, and 35, the animals in both groups were dosed systemically with freshly made luciferin at 150 mg/kg via intraperitoneal injection at 2.5 mL/kg. at 5-15 minutes post luciferin administration, all animals were imaged using IVIS while under isoflurane anesthesia. Total Flux [p/s] and average Flux (p/s/sr/$cm^2$) in a region of interest encompassing the eye were obtained over 5 minutes of exposure. The results were graphed as average radiance of each treatment group in the treated eye ("injected") relative to the average radiance of each treatment group in the untreated eye ("uninjected") (FIG. 9B). Significant fluorescence was readily detectable in the ceDNA vector-treated eyes but much weaker in the plasmid-treated eyes (FIG. 9A). After 35 days, the plasmid-injected rats were terminated, while the study continued for the ceDNA-treated rats, with luciferin injection and IVIS imaging at days 42, 49, 56, 63, 70, and 99. The results demonstrate that ceDNA vector introduced in a single injection to rat eye mediated transgene expression in vivo and that that expression was sustained at a high level at least through 99 days after injection.

Example 10: Sustained Dosing and Redosing of ceDNA Vector in Rag2 Mice

In situations where one or more of the transgenes encoded in the gene expression cassette of the ceDNA vector is expressed in a host environment (e.g., cell or subject) where the expressed protein is recognized as foreign, the possibility exists that the host will mount an adaptive immune response that may result in undesired depletion of the expression product, which could potentially be confused for lack of expression. In some cases, this may occur with a reporter molecule that is heterologous to the normal host environment. Accordingly, ceDNA vector transgene expression was assessed in vivo in the Rag2 mouse model which lacks B and T cells and therefore does not mount an adaptive immune response to non-native murine proteins such as luciferase. Briefly, c57bl/6 and Rag2 knockout mice were dosed intravenously via tail vein injection with 0.5 mg/kg of LNP-encapsulated ceDNA vector expressing luciferase or a polyC control at day 0, and at day 21 certain mice were redosed with the same LNP-encapsulated ceDNA vector at the same dose level. All testing groups consisted of 4 mice each. IVIS imaging was performed after luciferin injection as described in Example 9 at weekly intervals.

Comparing the total flux observed from the IVIS analyses, the fluorescence observed in the wild-type mice (an indirect measure of the presence of expressed luciferase) dosed with LNP-ceDNA vector-Luc decreased gradually after day 21 whereas the Rag2 mice administered the same treatment displayed relatively constant sustained expression of luciferase over the 42 day experiment (FIG. 10A). The approximately 21-day time point of the observed decrease in the wild-type mice corresponds to the timeframe in which an adapative immune response might expect to be produced. Re-administration of the LNP-ceDNA vector in the Rag2 mice resulted in a marked increase in expression which was sustained over the at least 21 days it was tracked in this study (FIG. 10B). The results suggest that adaptive immunity may play a role when a non-native protein is expressed from a ceDNA vector in a host, and that observed decreases in expression in the 20+ day timeframe from initial administration may signal a confounding adaptive immune response to the expressed molecule rather than (or in addition to) a decline in expression. Of note, this response is expected to be low when expressing native proteins in a host where it is anticipated that the host will properly recognize the expressed molecules as self and will not develop such an immune response.

Example 11: Impact of Liver-Specific Expression and CpG Modulation on Sustained Expression As described in Example 10, undesired host immune response may in some cases artificially dampen what would otherwise be sustained expression of one or more desired transgenes from an introduced ceDNA vector. Two approaches were taken to assess the impact of avoiding and/or dampening potential host immune response on sustained expression from a ceDNA vector. First, since the ceDNA-Luc vector used in the preceding examples was under the control of a constitutive CAG promoter, a similar construct was made using a liver-specific promoter (hAAT) or a different constitutive promoter (hEF-1) to see whether avoiding prolonged exposure to myeloid cells or non-liver tissue reduced any observed immune effects. Second, certain of the ceDNA-luciferase constructs were engineered to be reduced in CpG content, a known trigger for host immune reaction. ceDNA-encoded luciferase gene expression upon administration of such engineered and promoter-switched ceDNA vectors to mice was measured.

Three different ceDNA vectors were used, each encoding luciferase as the transgene. The first ceDNA vector had a high number of unmethylated CpG (~350) and comprised the constitutive CAG promoter ("ceDNA CAG"); the second had a moderate number of unmethylated CpG (~60) and comprised the liver-specific hAAT promoter ("ceDNA hAAT low CpG"); and the third was a methylated form of the second, such that it contained no unmethylated CpG and also comprised the hAAT promoter ("ceDNA hAAT No CpG"). The ceDNA vectors were otherwise identical. The vectors were prepared as described above.

Four groups of four male CD-1® mice, approximately 4 weeks old, were treated with one of the ceDNA vectors encapsulated in an LNP or a polyC control. On day 0 each mouse was administered a single intravenous tail vein injection of 0.5 mg/kg ceDNA vector in a volume of 5 mL/kg. Body weights were recorded on days −1, −, 1, 2, 3, 7, and weekly thereafter until the mice were terminated. Whole blood and serum samples were taken on days 0, 1, and 35. In-life imaging was performed on days 7, 14, 21, 28, and 35, and weekly thereafter using an in vivo imaging system (IVIS). For the imaging, each mouse was injected with luciferin at 150 mg/kg via intraperitoneal injection at 2.5 mL/kg. After 15 minutes, each mouse was anaesthetized and imaged. The mice were terminated at day 93 and terminal tissues collected, including liver and spleen. Cytokine measurements were taken 6 hours after dosing on day 0.

While all of the ceDNA-treated mice displayed significant fluorescence at days 7 and 14, the fluorescence decreased rapidly in the ceDNA CAG mice after day 14 and more gradually decreased for the remainder of the study. In contrast, the total flux for the ceDNA hAAT low CpG and No CpG-treated mice remained at a steady high level (FIG. 11). This suggested that directing the ceDNA vector delivery specifically to the liver resulted in sustained, durable transgene expression from the vector over at least 77 days after a single injection. Constructs that were CpG minimized or completely absent of CpG content had similar durable sustained expression profiles, while the high CpG constitutive promoter construct exhibited a decline in expression over time, suggesting that host immune activation by the ceDNA vector introduction may play a role in any decreased expression observed from such vector in a subject. These results provide alternative methods of tailoring the duration of the response to the desired level by selecting a tissue-restricted promoter and/or altering the CpG content of the ceDNA vector in the event that a host immune response is observed—a potentially transgene-specific response.

Example 12: Hydrodynamic Delivery of ceDNA Expressing FVIII

A well-known method of introducing nucleic acid to the liver in rodents is by hydrodynamic tail vein injection. In this system, the pressurized injection in a large volume of non-encapsulated nucleic acid results in a transient increase in cell permeability and delivery directly into tissues and cells. This provides an experimental mechanism to bypass many of the host immune systems, such as macrophage delivery, providing the opportunity to observe delivery and expression in the absence of such activity.

Three different ceDNA vectors, each with a wild-type left ITR and a truncation mutant right ITR and having a transgene region encoding FVIII, were prepared and purified as described above in Examples 1 and 5. ceDNA FVIII vectors under the control of a liver-specific promoter or PBS alone were administered to male C57bl/6J mice of approximately 6 weeks of age. The naked ceDNA vectors were dosed at 0.005 mg per animal (4 animals per group) by hydrodynamic intravenous injection via lateral tail vein in a volume of either 1.2 mL administered over 5 seconds or at a dose of 100 mL/kg administered over 5-8 seconds. Body weights were measured on days 0, 1, 2, 3 and 7 and weekly thereafter. Blood samples were collected from each treated animal on days 3, 7, 14, 21, and at terminal day 28. The presence of expressed FVIII in the plasma samples was measured by the Human Total Factor VIII ELISA kit (Innovative Research).

Figure 11A:
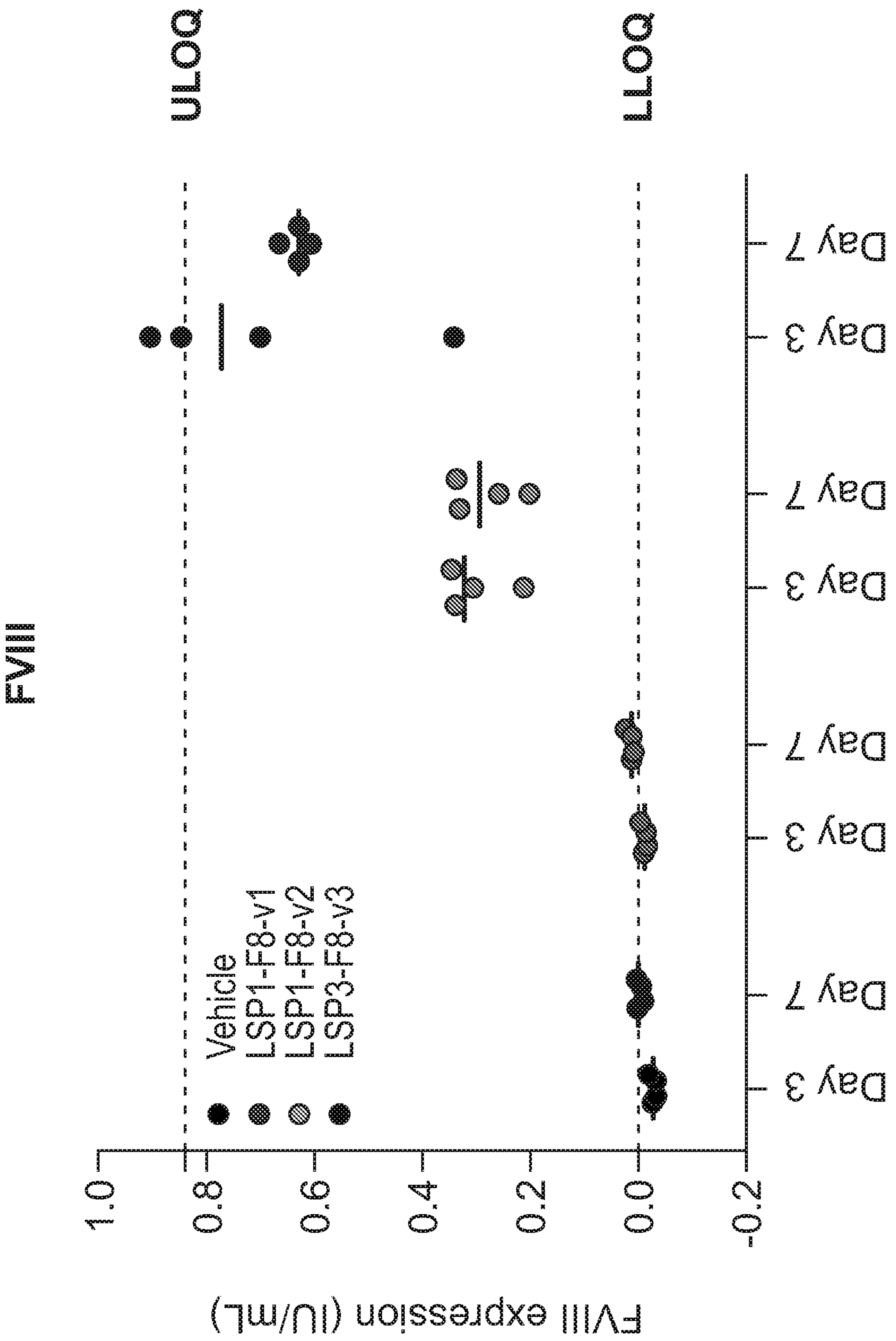
FIGS. 11A and 11B show hydrodynamic delivery of ceDNA vector expressing FVIII.
Figure 11B:
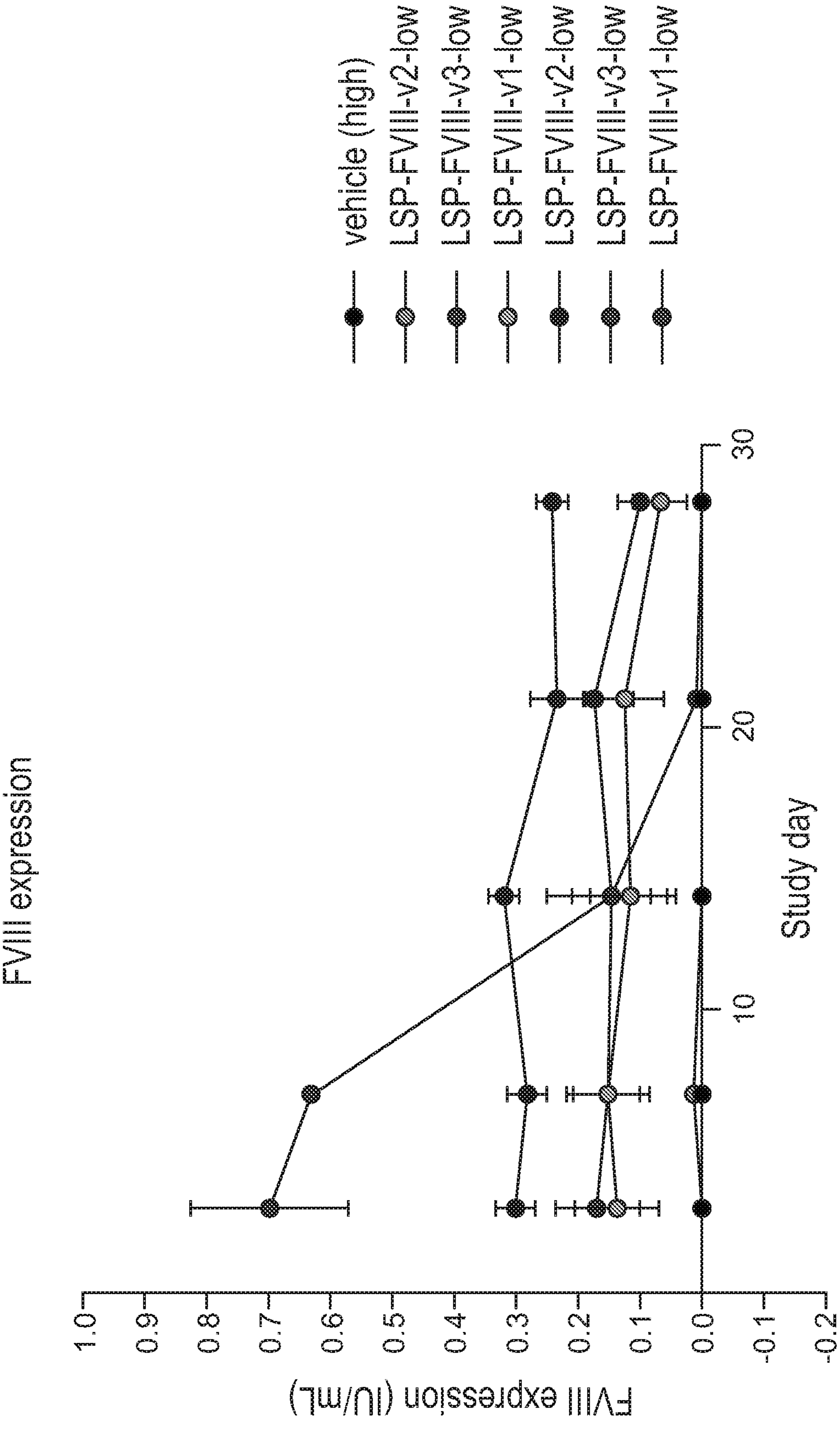

As shown in FIG. 11A, FVIII was readily detected in day 3 and 7 plasma samples from mice treated with two of the three ceDNA FVIII vectors, but was not observed in mice treated with PBS. FIG. 11B shows that FVIII expression was dose-volume dependent in the two vectors where FVIII expression was observed, and remained relatively constant over the 28-day study with the exception of vector 3, which decreased rapidly in expression after day 7. This experiment demonstrated that ceDNA vectors were able to express FVIII from the liver after hydrodynamic injection, and that FVIII was rapidly and readily detectable in the serum after ceDNA administration.

Example 13: Hydrodynamic Delivery of ceDNA Expressing FVIII-Testing of Various ceDNA Vectors Expressing FVIII A hydrodynamic delivery system as described in Example 12 was used to test the effect of various ceDNA vectors expressing FVIII on serum FVIII levels, where detection of FVIII in the serum indicated that the ceDNA vector was able to express FVIII after injection.

ceDNA vectors as described in Example 12 were prepared. Each of the ceDNA FVIII vectors (alone, without any LNP encapsulation) and the control were administered by hydrodynamic intravenous (IV) route of injection to C57BL/6 mice. The ceDNA vectors were dosed at 5 μg per animal (4 animals per group) by hydrodynamic intravenous injection via lateral tail vein in a volume of 90-100 mg/mL. The terminal timepoint was day 7. Vehicle alone was used as control.

The following ceDNA vectors were tested in three separate experiments. Sequences for the below ceDNA vectors are shown in Table 9. In Table 9, the open reading frame is shown by underlining. The promoter is shown in bold.

(1) ceDNAFVIII-vector 4, ceDNAFVIII-vector 6, ceDNAFVIII-vector 12, ceDNAFVIII-vector 14, ceDNAFVIII-vector 16, ceDNAFVIII-vector 18, ceDNAFVIII-vector 19, ceDNAFVIII-vector 21, ceDNAFVIII-vector 22;

(2) ceDNAFVIII-vector 1, ceDNAFVIII-vector 2, ceDNAFVIII-vector 3, ceDNAFVIII-vector 5, ceDNAFVIII-vector 7, ceDNAFVIII-vector 8, ceDNAFVIII-vector 12, ceDNAFVIII-vector 13, ceDNAFVIII-vector 15;

(3) ceDNAFVIII-vector 9, ceDNAFVIII-vector 10, ceDNAFVIII-vector 11, ceDNAFVIII-vector 12, ceDNAFVIII-vector 17, ceDNAFVIII-vector 20, ceDNAFVIII-vector 24, ceDNAFVIII-vector 25, ceDNAFVIII-vector 26.

TABLE 9

| ceDNA Vector Name | Nucleic Acid Sequence |
|---|---|
| ceDNAFVIII-vector 1 (SEQ ID NO: 192) | GACGCGCCCTGTAGCGGCGCATTAAGCGCGGCGGGTGTGGTGGTTACGCGCAGCGTGACCGCTACACTTGCCAGCGCCCTAGCGCCCGCTCCTTTCGC<br>TTTCTTCCCTTCCTTTCTCGCCACGTTCGCCGGCTTTCCCCGTCAAGCTCTAAATCGGGGGCTCCCTTTAGGGTTCCGATTTAGTGCTTTACGGCACC<br>TCGACCCCAAAAAACTTGATTAGGGTGATGGTTCACGTAGTGGGCCATCGCCCTGATAGACGGTTTTTCGCCCTTTGACGTTGGAGTCCACGTTCTTT<br>AATAGTGGACTCTTGTTCCAAACTGGAACAACACTCAACCCTATCTCGGTCTATTCTTTTGATTTATAAGGGATTTTGCCGATTTCGGCCTATTGGTT<br>AAAAAATGAGCTGATTTAACAAAAATTTAACGCGAATTTTAACAAAATATTAACGTTTACAATTTCAGGTGGCACTTTTCGGGGAAATGTGCGCGGAA<br>CCCCTATTTGTTTATTTTTCTAAATACATTCAAATATGTATCCGCTCATGAGACAATAACCCTGATAAATGCTTCAATAATATTGAAAAAGGAAGAGT<br>ATGAGTATTCAACATTTCCGTGTCGCCCTTATTCCCTTTTTTGCGGCATTTTGCCTTCCTGTTTTTGCTCACCCAGAAACGCTGGTGAAAGTAAAAGA<br>TGCTGAAGATCAGTTGGGTGCACGAGTGGGTTACATCGAACTGGATCTCAACAGCGGTAAGATCCTTGAGAGTTTTCGCCCCGAAGAACGTTTTCCAA<br>TGATGAGCACTTTTAAAGTTCTGCTATGTGGCGCGGTATTATCCCGTATTGACGCCGGGCAAGAGCAACTCGGTCGCCGCATACACTATTCTCAGAAT<br>GACTTGGTTGAGTACTCACCAGTCACAGAAAAGCATCTTACGGATGGCATGACAGTAAGAGAATTATGCAGTGCTGCCATAACCATGAGTGATAACAC<br>TGCGGCCAACTTACTTCTGACAACGATCGGAGGACCGAAGGAGCTAACCGCTTTTTTGCACAACATGGGGGATCATGTAACTCGCCTTGATCGTTGGG<br>AACCGGAGCTGAATGAAGCCATACCAAACGACGAGCGTGACACCACGATGCCTGTAGCAATGGCAACAACGTTGCGCAAACTATTAACTGGCGAACTA<br>CTTACTCTAGCTTCCCGGCAACAATTAATAGACTGGATGGAGGCGGATAAAGTTGCAGGACCACTTCTGCGCTCGGCCCTTCCGGCTGGCTGGTTTAT<br>TGCTGATAAATCTGGAGCCGGTGAGCGTGGGTCTCGCGGTATCATTGCAGCACTGGGGCCAGATGGTAAGCCCTCCCGTATCGTAGTTATCTACACGA<br>CGGGGAGTCAGGCAACTATGGATGAACGAAATAGACAGATCGCTGAGATAGGTGCCTCACTGATTAAGCATTGGTAACTGTCAGACCAAGTTTACTCA<br>TATATACTTTAGATTGATTTAAAACTTCATTTTTAATTTAAAAGGATCTAGGTGAAGATCCTTTTTGATAATCTCATGACCAAAATCCCTTAACGTGA<br>GTTTTCGTTCCACTGAGCGTCAGACCCCGTAGAAAAGATCAAAGGATCTTCTTGAGATCCTTTTTTTCTGCGCGTAATCTGCTGCTTGCAAACAAAAA<br>AACCACCGCTACCAGCGGTGGTTTGTTTGCCGGATCAAGAGCTACCAACTCTTTTTCCGAAGGTAACTGGCTTCAGCAGAGCGCAGATACCAAATACT<br>GTCCTTCTAGTGTAGCCGTAGTTAGGCCACCACTTCAAGAACTCTGTAGCACCGCCTACATACCTCGCTCTGCTAATCCTGTTACCAGTGGCTGCTGC<br>CAGTGGCGATAAGTCGTGTCTTACCGGGTTGGACTCAAGACGATAGTTACCGGATAAGGCGCAGCGGTCGGGCTGAACGGGGGGTTCGTGCACACAGC<br>CCAGCTTGGAGCGAACGACCTACACCGAACTGAGATACCTACAGCGTGAGCATTGAGAAAGCGCCACGCTTCCCGAAGGGAGAAAGGCGGACAGGTAT<br>CCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTG<br>ACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGC<br>CTTTTGCTCACATGTTCTTTCCTGCGTTATCCCCTGATTCTGTGGATAACCGTATTACCGCCTTTGAGTGAGCTGATACCGCTCGCCGCAGCCGAACG<br>ACCGAGCGCAGCGAGTCAGTGAGCGAGGAAGCGGAAGAGCGCCTGATGCGGTATTTTCTCCTTACGCATCTGTGCGGTATTTCACACCGCAGACCAGC<br>CGCGTAACCTGGCAAAATCGGTTACGGTTGAGTAATAAATGGATGCCCTGCGTAAGCGGGTGTGGGCGGACAATAAAGTCTTAAACTGAACAAAATAG<br>ATCTAAACTATGACAATAAAGTCTTAAACTAGACAGAATAGTTGTAAACTGAAATCAGTCCAGTTATGCTGTGAAAAAGCATACTGGACTTTTGTTAT<br>GGCTAAAGCAAACTCTTCATTTTCTGAAGTGCAAATTGCCCGTCGTATTAAAGAGGGGCGTGGCCAAGGGCATGGTAAAGACTATATTCGCGGCGTTG<br>TGACAATTTACCGAACAACTCCGCGGCCGGGAAGCCGATCTCGGCTTGAACGAATTGTTAGGTGGCGGTACTTGGGTCGATATCAAAGTGCATCACTT<br>CTTCCCGTATGCCCAACTTTGTATAGAGAGCCACTGCGGGATCGTCACCGTAATCTGCTTGCACGTAGATCACATAAGCACCAAGCGCGTTGGCCTCA<br>TGCTTGAGGAGATTGATGAGCGCGGTGGCAATGCCCTGCCTCCGGTGCTCGCCGGAGACTGCGAGATCATAGATATAGATCTCACTACGCGGCTGCTC<br>AAACCTGGGCAGAACGTAAGCCGCGAGAGCGCCAACAACCGCTTCTTGGTCGAAGGCAGCAAGCGCGATGAATGTCTTACTACGGAGCAAGTTCCCGA<br>GGTAATCGGAGTCCGGCTGATGTTGGGAGTAGGTGGCTACGTCTCCGAACTCACGACCGAAAAGATCAAGAGCAGCCCGCATGGATTTGACTTGGTCA<br>GGGCCGAGCCTACATGTGCGAATGATGCCCATACTTGAGCCACCTAACTTTGTTTTAGGGCGACTGCCCTGCTGCGTAACATCGTTGCTGCTGCGTAA<br>CATCGTTGCTGCTCCATAACATCAAACATCGACCCACGGCGTAACGCGCTTGCTGCTTGGATGCCCGAGGCATAGACTGTACAAAAAAACAGTCATAA<br>CAAGCCATGAAAACCGCCACTGCGCCGTTACCACCGCTGCGTTCGGTCAAGGTTCTGGACCAGTTGCGTGAGCGCATACGCTACTTGCATTACAGTTT<br>ACGAACCGAACAGGCTTATGTCAACTGGGTTCGTGCCTTCATCCGTTTCCACGGTGTGCGTCACCCGGCAACCTTGGGCAGCAGCGAAGTCGAGGCAT<br>TTCTGTCCTGGCTGGCGAACGAGCGCAAGGTTTCGGTCTCCACGCATCGTCAGGCATTGGCGGCCTTGCTGTTCTTCTACGGCAAGGTGCTGTGCACG<br>GATCTGCCCTGGCTTCAGGAGATCGGAAGACCTCGGCCGTCGCGGCGCTTGCCGGTGGTGCTGACCCCGGATGAAGTGGTTCGCATCCTCGGTTTTCT<br>GGAAGGCGAGCATCGTTTGTTCGCCCAGGACTCTAGCTATAGTTCTAGTGGTTGGCTACGTATACTCCGGAATATTAATAGATCATGGAGATAATTAA<br>AATGATAACCATCTCGCAAATAAATAAGTATTTTACTGTTTTCGTAACAGTTTTGTAATAAAAAAACCTATAAATATTCCGGATTATTCATACCGTCC<br>CACCATCGGGCGCGGATCTCGGTCCGAAACCATGTCGTACTACCATCACCATCACCATCACGATTACGATATCCCAACGACCGAAAACCTGTATTTTC<br>AGGGCGCCATGGGATCCGGCCGGCCCCTGCAGGCAGCTGCGCGCTCGCTCGCTCACTGAGGCCGCCCGGGCAAAGCCCGGGCGTCGGGCGACCTTTGG<br>TCGCCCGGCCTCAGTGAGCGAGCGAGCGCGCAGAGAGGGAGTGGCCAACTCCATCACTAGGGGTTCCTTGTAGTTAATGATTAACCCGCCATGCTACT<br>TATCTACGTAGCCATGCTCTAGAGCGGCCGCAGGCTCAGAGGCACACAGGAGTTTCTGGGCTCACCCTGCCCCCTTCCAACCCCTCAGTTCCCATCCT<br>CCAGCAGCTGTTTGTGTGCTGCCTCTGAAGTCCACACTGAACAAACTTCAGCCTACTCATGTCCCTAAAATGGGCAAACATTGCAAGCAGCAAACAGC<br>AAACACACAGCCCTCCCTGCCTGCTGACCTTGGAGCTGGGGCAGAGGTCAGAGACCTCTCTGGGCCCATGCCACCTCCAACATCCACTCGACCCCTTG<br>GAATTTCGGTGGAGAGGAGCAGAGGTTGTCCTGGCGTGGTTTAGGTAGTGTGAGAGGGTCCGGGTTCAAAACCACTTGCTGGGTGGGGAGTCGTCAGT |

TABLE 9-continued

| ceDNA Vector Name | Nucleic Acid Sequence |
|---|---|
| | AAGTGGCTATGCCCCGACCCCGAAGCCTGTTTCCCCATCTGTACAATGGAAATGATAAAGACGCCCATCTGATAGGGTTTTTGTGGCAAATAAACATT |
| | TGGTTTTTTTGTTTTGTTTTGTTTTGTTTTTTGAGATGGAGGTTTGCTCTGTCGCCCAGGCTGGAGTGCAGTGACACAATCTCATCTCACCACAACCT |
| | TCCCCTGCCTCAGCCTCCCAAGTAGCTGGGATTACAAGCATGTGCCACCACACCTGGCTAATTTTCTATTTTTAGTAGAGACGGGTTTCTCCATGTTG |
| | GTCAGCCTCAGCCTCCCAAGTAACTGGGATTACAGGCCTGTGCCACCACACCCGGCTAATTTTTTCTATTTTTGACAGGGACGGGGTTTCACCATGTT |
| | GGTCAGGCTGGTCTAGAGGTACCG**GATCTTGCTACCAGTGGAACAGCCACTAAGGATTCTGCAGTGAGAGCAGAGGGCCAGCTAAGTGGTACTCTCCC** |
| | **AGAGACTGTCTGACTCACGCCACCCCCTCCACCTTGGACACAGGACGCTGTGGTTTCTGAGCCAGGTACAATGACTCCTTTCGGTAAGTGCAGTGGAA** |
| | **GCTGTACACTGCCCAGGCAAAGCGTCCGGGCAGCGTAGGCGGGCGACTCAGATCCCAGCCAGTGGACTTAGCCCCTGTTTGCT**CCTCCGATAACTGGG |
| | GTGACCTTGGTTAATATTCACCAGCAGCCTCCCCCGTTGCCCCTCTGGATCCACTGCTTAAATACGGACGAGGACAGGGCCCTGTCTCCTCAGCTTCA |
| | GGCACCACCACTGACCTGGGACAGTGAATCCGGACTCTAAGGTAAATATAAAATTTTTAAGTGTATAATGTGTTAAACTACTGATTCTAATTGTTTCT |
| | CTCTTTTAGATTCCAACCTTTGGAACTGAGTTTAAACCGCAGCCACCATGCAGATCGAGCTGTCTACCTGCTTCTTCCTGTGCCTGCTGCGGTTCTGC |
| | TTCAGCGCCACCAGAAGATATTACCTGGGCGCCGTGGAACTGAGCTGGGACTACATGCAGTCTGACCTGGGAGAGCTGCCCGTGGACGCTAGATTTCC |
| | TCCAAGAGTGCCCAAGAGCTTCCCCTTCAACACCTCCGTGGTGTACAAGAAAACCCTGTTCGTGGAATTCACCGACCACCTGTTCAATATCGCCAAGC |
| | CTCGGCCTCCTTGGATGGGACTGCTGGGACCTACAATTCAGGCCGAGGTGTACGACACCGTGGTCATCACCCTGAAGAACATGGCCAGCCATCCTGTG |
| | TCTCTGCACGCCGTGGGAGTGTCTTATTGGAAGGCTTCTGAGGGCGCCGAGTACGACGATCAGACAAGCCAGAGAGAGAAAGAGGACGACAAGGTTTT |
| | CCCTGGCGGCAGCCACACCTATGTCTGGCAGGTCCTGAAAGAAAACGGCCCTATGGCCTCCGATCCTCTGTGCCTGACATACAGCTACCTGAGCCACG |
| | TGGACCTGGTCAAGGACCTGAATTCTGGCCTGATCGGAGCCCTGCTCGTGTGTAGAGAAGGCAGCCTGGCCAAAGAGAAAACCCAGACACTGCACAAG |
| | TTCATCCTGCTGTTCGCCGTGTTCGACGAGGGCAAGAGCTGGCACAGCGAGACAAAGAACAGCCTGATGCAGGACAGGGATGCCGCCTCTGCTAGAGC |
| | TTGGCCTAAGATGCACACCGTGAACGGCTACGTGAACAGAAGCCTGCCTGGACTGATCGGCTGCCACAGAAAGTCCGTGTACTGGCACGTGATCGGCA |
| | TGGGCACAACACCTGAGGTGCACAGCATCTTTCTGGAAGGCCACACCTTCCTCGTGCGGAACCACAGACAGGCCAGCCTGGAAATCAGCCCTATCACC |
| | TTCCTGACCGCTCAGACCCTGCTGATGGATCTGGGCCAGTTTCTGCTGTTCTGCCACATCAGCTCCCACCAGCACGATGGCATGGAAGCCTACGTGAA |
| | GGTGGACAGCTGCCCCGAAGAACCCCAGCTGCGGATGAAGAACAACGAGGAAGCCGAGGACTACGACGACGACCTGACCGACTCTGAGATGGACGTCG |
| | TCAGATTCGACGACGATAACAGCCCCAGCTTCATCCAGATCAGAAGCGTGGCCAAGAAGCACCCCAAGACCTGGGTGCACTATATCGCCGCCGAGGAA |
| | GAGGACTGGGATTACGCTCCTCTGGTGCTGGCCCCTGACGACAGAAGCTACAAGAGCCAGTACCTGAACAACGGCCCTCAGCGGATCGGCCGGAAGTA |
| | TAAGAAAGTGCGGTTCATGGCCTACACCGACGAGACATTCAAGACCAGAGAGGCCATCCAGCACGAGAGCGGAATTCTGGGCCCTCTGCTGTATGGCG |
| | AAGTGGGCGATACACTGCTGATCATCTTCAAGAACCAGGCCAGCAGACCCTACAACATCTACCCTCACGGCATCACCGATGTGCGGCCCCTGTATTCT |
| | AGAAGGCTGCCCAAGGGCGTGAAGCACCTGAAGGACTTCCCTATCCTGCCTGGCGAGATTTTCAAGTACAAGTGGACCGTGACCGTGGAAGATGGCCC |
| | CACCAAGAGCGACCCTAGATGTCTGACACGGTACTACAGCAGCTTCGTGAACATGGAACGCGACCTGGCCAGCGGCCTGATTGGACCTCTGCTGATCT |
| | GCTACAAAGAAAGCGTGGACCAGCGGGGCAACCAGATCATGAGCGACAAGCGGAACGTGATCCTGTTTAGCGTGTTCGATGAGAACCGGTCCTGGTAT |
| | CTGACCGAGAACATCCAGCGGTTTCTGCCCAATCCTGCCGGGGTGCAACTGGAAGATCCTGAGTTCCAGGCAAGCAACATCATGCACTCCATCAATGG |
| | CTATGTGTTCGACAGCCTGCAGCTGAGCGTGTGCCTGCACGAAGTGGCCTACTGGTACATCCTGAGCATTGGCGCCCAGACCGACTTCCTGTCCGTGT |
| | TCTTTAGCGGCTACACCTTCAAGCACAAGATGGTGTACGAGGATACCCTGACACTGTTCCCATTCAGCGGCGAGACAGTGTTCATGAGCATGGAAAAC |
| | CCCGGCCTGTGGATTCTGGGCTGTCACAACAGCGACTTCCGGAACAGAGGCATGACAGCCCTGCTGAAGGTGTCCAGCTGCGACAAGAACACCGGCGA |
| | CTACTACGAGGACAGCTATGAGGACATCAGCGCCTACCTGCTGAGCAAGAACAATGCCATCGAGCCCAGAAGCTTCAGCCAGAATAGCAGACACCCCT |
| | CCACCAGACAGAAGCAGTTCAACGCCACAACAATCCCCGAGAACGACATCGAGAAAACCGATCCTTGGTTTGCCCACAGAACCCCTATGCCTAAGATC |
| | CAGAACGTGTCCTCCAGCGATCTGCTGATGCTCCTGAGACAGAGCCCTACACCTCACGGACTGAGCCTGTCCGATCTGCAAGAGGCCAAATACGAAAC |
| | CTTCAGCGACGACCCTTCTCCTGGCGCCATCGACAGCAACAATAGCCTGAGCGAGATGACCCACTTCAGACCACAGCTGCACCACAGCGGCGACATGG |
| | TGTTTACACCTGAGAGCGGCCTCCAGCTGAGACTGAATGAGAAGCTGGGAACCACCGCCGCCACCGAGCTGAAGAAACTGGACTTCAAGGTGTCCTCT |
| | ACCAGCAACAACCTGATCAGCACAATCCCCTCCGACAACCTGGCTGCCGGCACCGACAACACATCTTCTCTGGGCCCACCTAGCATGCCCGTGCACTA |
| | CGATAGCCAGCTGGATACCACACTGTTCGGCAAGAAGTCTAGCCCTCTGACAGAGTCTGGCGGCCCTCTGTCTCTGAGCGAGGAAAACAACGACAGCA |
| | AGCTGCTGGAATCCGGCCTGATGAACAGCCAAGAGTCCTCCTGGGGCAAGAATGTGTCCAGCACCGAGTCCGGCAGACTGTTCAAGGGAAAGAGAGCC |
| | CACGGACCTGCTCTGCTGACCAAGGATAACGCCCTGTTCAAAGTGTCCATCAGCCTGCTCAAGACCAACAAGACCTCCAACAACTCCGCCACCAACAG |
| | AAAGACCCACATCGACGGCCCTAGCCTGCTGATCGAGAATAGCCCTAGCGTCTGGCAGAATATCCTGGAAAGCGACACCGAGTTCAAGAAAGTGACCC |
| | CTCTGATCCACGACCGGATGCTCATGGACAAGAACGCCACCGCTCTGCGGCTGAACCACATGAGCAACAAGACAACCAGCAGCAAGAATATGGAAATG |
| | GTGCAGCAGAAGAAAGAGGGCCCCATTCCTCCAGACGCTCAGAACCCCGATATGAGCTTCTTCAAGATGCTCTTTCTGCCCGAGAGCGCCCGGTGGAT |
| | TCAGAGAACACACGGCAAGAACTCCCTGAACTCCGGCCAGGGACCTTCTCCAAAGCAGCTGGTTTCCCTGGGACCTGAGAAGTCCGTGGAAGGACAGA |
| | ACTTCCTGAGCGAAAAGAACAAAGTGGTCGTCGGCAAGGGCGAGTTCACCAAGGATGTGGGCCTGAAAGAGATGGTCTTTCCCAGCAGCCGGAACCTG |
| | TTCCTGACCAACCTGGACAACCTGCACGAGAACAACACCCACAATCAAGAGAAGAAGATCCAAGAGGAAATCGAAAAGAAAGAGACACTCATCCAAGA |
| | GAACGTGGTGCTGCCTCAGATCCACACAGTGACCGGCACCAAGAACTTTATGAAGAATCTGTTCCTGCTGAGTACCCGGCAGAACGTGGAAGGCAGCT |
| | ACGATGGCGCTTATGCCCCTGTGCTGCAGGACTTCAGATCCCTGAACGACTCCACCAATCGGACAAAGAAGCACACAGCCCACTTCTCCAAGAAGGGC |
| | GAAGAAGAGAACCTGGAAGGACTGGGCAATCAGACCAAGCAGATCGTCGAGAAGTACGCCTGCACCACCAGAATCAGCCCCAACACAAGCCAGCAGAA |

TABLE 9-continued

| ceDNA Vector Name | Nucleic Acid Sequence |
|---|---|
| | CTTCGTGACCCAGCGGAGCAAAAGAGCCCTGAAGCAGTTTCGGCTGCCCCTGGAAGAAACCGAGCTGGAAAAGCGGATCATCGTGGACGACACCAGCA |
| | CACAGTGGTCCAAGAACATGAAGCACTTGACCCCTAGCACACTGACCCAGATCGACTACAACGAGAAAGAGAAGGGCGCTATCACACAGAGCCCACTG |
| | AGCGACTGTCTGACCAGAAGCCACAGCATCCCTCAGGCCAACAGATCCCCTCTGCCAATCGCCAAAGTGTCTAGCTTCCCCAGCATCAGACCCATCTA |
| | CCTGACCAGAGTGCTGTTCCAGGACAACAGCAGCCATCTGCCAGCCGCCAGCTACCGGAAGAAAGATTCTGGCGTGCAAGAGAGCAGCCACTTTCTGC |
| | AGGGCGCTAAGAAGAACAATCTGAGCCTGGCTATTCTGACCCTGGAAATGACCGGCGATCAGAGAGAAGTCGGCTCTCTGGGCACCAGCGCCACAAAT |
| | AGCGTGACCTACAAAAAGGTGGAAAACACCGTGCTGCCTAAGCCTGACCTGCCAAAGACAAGCGGCAAGGTGGAACTGCTGCCAAAGGTGCACATCTA |
| | CCAGAAGGACCTGTTTCCTACCGAGACAAGCAACGGCTCTCCCGGCCATCTGGATCTGGTGGAAGGATCTCTGCTGCAGGGAACCGAGGGCGCCATCA |
| | AGTGGAACGAGGCCAATAGACCTGGCAAGGTGCCCTTCCTGAGAGTGGCCACAGAGTCCAGCGCCAAGACACCCTCTAAACTGCTGGACCCTCTGGCC |
| | TGGGACAACCACTATGGCACTCAGATCCCCAAAGAGGAATGGAAGTCCCAAGAGAAGTCCCCTGAAAAGACCGCCTTCAAGAAGAAGGACACCATTCT |
| | GTCCCTGAATGCCTGCGAGAGCAACCACGCCATTGCCGCCATCAATGAGGGCCAGAACAAGCCCGAGATCGAAGTGACCTGGGCCAAGCAGGGAAGAA |
| | CCGAGAGACTGTGTAGCCAGAATCCTCCTGTGCTGAAGCGGCACCAGAGAGAAATCACCCGGACCACACTGCAGAGCGACCAAGAAGAGATCGATTAC |
| | GACGATACCATCAGCGTCGAGATGAAGAAAGAAGATTTCGACATCTACGACGAGGACGAGAATCAGAGCCCTCGGAGCTTCCAGAAGAAAACCAGGCA |
| | CTACTTTATTGCCGCCGTCGAGCGGCTGTGGGACTACGGAATGTCTAGCTCTCCTCACGTGCTGCGGAATAGAGCCCAGTCTGGTAGCGTGCCCCAGT |
| | TCAAAAAGGTCGTGTTCCAAGAGTTCACCGACGGCAGCTTCACCCAGCCACTGTATAGAGGCGAGCTGAACGAGCATCTGGGCCTGCTGGGCCCTTAT |
| | ATCAGAGCCGAAGTGGAAGATAACATCATGGTCACCTTCCGGAATCAGGCTAGCCGGCCTTACAGCTTCTACAGCTCCCTGATCTCCTACGAAGAGGA |
| | CCAGAGACAGGGCGCAGAGCCCCGGAAGAATTTCGTGAAGCCCAACGAGACTAAGACCTACTTTTGGAAGGTGCAGCACCATATGGCCCCTACAAAGG |
| | ACGAGTTCGACTGCAAAGCCTGGGCCTACTTCTCCGATGTGGACCTCGAAAAGGACGTGCACAGCGGACTCATCGGCCCACTGCTTGTGTGCCACACC |
| | AACACACTGAACCCCGCTCACGGCAGACAAGTGACAGTGCAAGAGTTCGCCCTGTTTTTCACCATCTTCGACGAAACGAAGTCCTGGTACTTCACCGA |
| | AAACATGGAAAGAAACTGCAGGGCCCCTTGCAACATTCAGATGGAAGATCCCACCTTCAAAGAGAACTACCGGTTCCACGCCATCAACGGCTACATCA |
| | TGGACACACTGCCCGGCCTGGTTATGGCCCAGGATCAGAGAATCCGGTGGTATCTGCTGTCCATGGGCTCCAACGAGAATATCCACTCCATCCACTTC |
| | AGCGGCCACGTGTTCACCGTGCGGAAAAAAGAAGAGTACAAAATGGCCCTGTACAATCTGTACCCTGGGGTGTTCGAAACCGTTGAGATGCTGCCTAG |
| | CAAGGCCGGAATTTGGAGAGTGGAATGTCTGATTGGAGAGCACCTCCACGCCGGGATGAGCACCCTGTTTCTGGTGTACTCCAACAAGTGTCAGACCC |
| | CTCTCGGCATGGCCTCTGGCCACATTAGAGACTTCCAGATCACCGCCAGCGGACAGTATGGACAGTGGGCCCCTAAACTGGCCAGACTGCACTACTCC |
| | GGCAGCATCAATGCCTGGTCCACCAAAGAGCCTTTCAGCTGGATCAAAGTGGACCTGCTGGCTCCCATGATCATCCACGGAATCAAGACCCAGGGCGC |
| | CAGACAAAAGTTCAGCAGCCTGTACATCAGCCAGTTCATCATCATGTACAGCCTGGACGGAAAGAAGTGGCAGACCTACCGGGGCAATAGCACCGGCA |
| | CACTGATGGTGTTCTTCGGCAACGTGGACTCCAGCGGCATTAAGCACAACATCTTCAACCCTCCAATCATTGCCCGGTACATCCGGCTGCACCCCACA |
| | CACTACAGCATCAGGTCTACCCTGAGAATGGAACTGATGGGCTGCGACCTGAACAGCTGCTCTATGCCCCTCGGAATGGAAAGCAAGGCCATCAGCGA |
| | CGCCCAGATCACAGCCTCTAGCTACTTCACCAACATGTTCGCCACTTGGAGCCCCTCTAAGGCCCGGCTTCATCTGCAAGGCAGAAGCAACGCTTGGA |
| | GGCCCCAAGTGAACAACCCCAAAGAATGGCTCCAGGTGGACTTTCAGAAAACCATGAAAGTGACAGGCGTGACCACACAGGGCGTCAAGTCCCTGCTG |
| | ACCTCTATGTACGTGAAAGAGTTTCTGATCAGCTCCAGCCAGGACGGCCACCAGTGGACCCTGTTCTTCCAGAACGGCAAAGTGAAAGTGTTCCAGGG |
| | AAATCAGGACAGCTTCACACCCGTGGTCAATAGTCTGGACCCACCACTGCTGACCCGCTACCTGCGAATTCACCCTCAGTCTTGGGTGCACCAGATTG |
| | CCCTGCGGATGGAAGTGCTGGGCTGTGAAGCTCAGGACCTCTACTAGTTAATTAAGAGCATCTTACCGCCATTTATTCCCATATTTGTTCTGTTTTTC |
| | TTGATTTGGGTATACATTTAAATGTTAATAAAACAAAATGGTGGGGCAATCATTTACATTTTTAGGGATATGTAATTACTAGTTCAGGTGTATTGCCA |
| | CAAGACAAACATGTTAAGAAACTTTCCCGTTATTTACGCTCTGTTCCTGTTAATCAACCTCTGGATTACAAAATTTGTGAAAGATTGACTGATATTCT |
| | TAACTATGTTGCTCCTTTTACGCTGTGTGGATATGCTGCTTTATAGCCTCTGTATCTAGCTATTGCTTCCCGTACGGCTTTCGTTTTCTCCTCCTTGT |
| | ATAAATCCTGGTTGCTGTCTCTTTTAGAGGAGTTGTGGCCCGTTGTCCGTCAACGTGGCGTGGTGTGCTCTGTGTTTGCTGACGCAACCCCCACTGGC |
| | TGGGGCATTGCCACCACCTGTCAACTCCTTTCTGGGACTTTCGCTTTCCCCCTCCCGATCGCCACGGCAGAACTCATCGCCGCCTGCCTTGCCCGCTG |
| | CTGGACAGGGGCTAGGTTGCTGGGCACTGATAATTCCGTGGTGTTGTCTGTGCCTTCTAGTTGCCAGCCATCTGTTGTTTGCCCCTCCCCCGTGCCTT |
| | CCTTGACCCTGGAAGGTGCCACTCCCACTGTCCTTTCCTAATAAAATGAGGAAATTGCATCGCATTGTCTGAGTAGGTGTCATTCTATTCTGGGGGGT |
| | GGGGTGGGGCAGGACAGCAAGGGGGAGGATTGGGAAGACAATAGCAGGCATGCTGGGGATGCGGTGGGCTCTATGGCTCTAGAGCATGGCTACGTAGA |
| | TAAGTAGCATGGCGGGTTAATCATTAACTACACCTGCAGGAGGAACCCCTAGTGATGGAGTTGGCCACTCCCTCTCTGCGCGCTCGCTCGCTCACTGA |
| | GGCCGGGCGACCAAAGGTCGCCCGACGCCCGGGCGGCCTCAGTGAGCGAGCGAGCGCGCAGCTGCCTGCAGGGGCGCGCCTCGAGGCATGCGGTACCA |
| | AGCTTGTCGAGAAGTACTAGAGGATCATAATCAGCCATACCACATTTGTAGAGGTTTTACTTGCTTTAAAAAACCTCCCACACCTCCCCCTGAACCTG |
| | AAACATAAAATGAATGCAATTGTTGTTGTTAACTTGTTTATTGCAGCTTATAATGGTTACAAATAAAGCAATAGCATCACAAATTTCACAAATAAAGC |
| | ATTTTTTTCACTGCATTCTAGTTGTGGTTTGTCCAAACTCATCAATGTATCTTATCATGTCTGGATCTGATCACTGATATCGCCTAGGAGATCCGAAC |
| | CAGATAAGTGAAATCTAGTTCCAAACTATTTTGTCATTTTTAATTTTCGTATTAGCTTACGACGCTACACCCAGTTCCCATCTATTTTGTCACTCTTC |
| | CCTAAATAATCCTTAAAAACTCCATTTCCACCCCTCCCAGTTCCCAACTATTTTGTCCGCCCACAGCGGGGCATTTTTCTTCCTGTTATGTTTTTAAT |
| | CAAACATCCTGCCAACTCCATGTGACAAACCGTCATCTTCGGCTACTTTTTCTCTGTCACAGAATGAAAATTTTTCTGTCATCTCTTCGTTATTAATG |
| | TTTGTAATTGACTGAATATCAACGCTTATTTGCAGCCTGAATGGCGAATGG |

TABLE 9-continued

| ceDNA Vector Name | Nucleic Acid Sequence |
|---|---|
| ceDNAFVIII-vector 2 (SEQ ID NO: 193) | GACGCGCCCTGTAGCGGCGCATTAAGCGCGGCGGGTGTGGTGGTTACGCGCAGCGTGACCGCTACACTTGCCAGCGCCCTAGCGCCCGCTCCTTTCGC<br>TTTCTTCCCTTCCTTTCTCGCCACGTTCGCCGGCTTTCCCCGTCAAGCTCTAAATCGGGGGCTCCCTTTAGGGTTCCGATTTAGTGCTTTACGGCACC<br>TCGACCCCAAAAAACTTGATTAGGGTGATGGTTCACGTAGTGGGCCATCGCCCTGATAGACGGTTTTTCGCCCTTTGACGTTGGAGTCCACGTTCTTT<br>AATAGTGGACTCTTGTTCCAAACTGGAACAACACTCAACCCTATCTCGGTCTATTCTTTTGATTTATAAGGGATTTTGCCGATTTCGGCCTATTGGTT<br>AAAAAATGAGCTGATTTAACAAAAATTTAACGCGAATTTTAACAAAATATTAACGTTTACAATTTCAGGTGGCACTTTTCGGGGAAATGTGCGCGGAA<br>CCCCTATTTGTTTATTTTTCTAAATACATTCAAATATGTATCCGCTCATGAGACAATAACCCTGATAAATGCTTCAATAATATTGAAAAAGGAAGAGT<br>ATGAGTATTCAACATTTCCGTGTCGCCCTTATTCCCTTTTTTGCGGCATTTTGCCTTCCTGTTTTTGCTCACCCAGAAACGCTGGTGAAAGTAAAAGA<br>TGCTGAAGATCAGTTGGGTGCACGAGTGGGTTACATCGAACTGGATCTCAACAGCGGTAAGATCCTTGAGAGTTTTCGCCCCGAAGAACGTTTTCCAA<br>TGATGAGCACTTTTAAAGTTCTGCTATGTGGCGCGGTATTATCCCGTATTGACGCCGGGCAAGAGCAACTCGGTCGCCGCATACACTATTCTCAGAAT<br>GACTTGGTTGAGTACTCACCAGTCACAGAAAAGCATCTTACGGATGGCATGACAGTAAGAGAATTATGCAGTGCTGCCATAACCATGAGTGATAACAC<br>TGCGGCCAACTTACTTCTGACAACGATCGGAGGACCGAAGGAGCTAACCGCTTTTTTGCACAACATGGGGGATCATGTAACTCGCCTTGATCGTTGGG<br>AACCGGAGCTGAATGAAGCCATACCAAACGACGAGCGTGACACCACGATGCCTGTAGCAATGGCAACAACGTTGCGCAAACTATTAACTGGCGAACTA<br>CTTACTCTAGCTTCCCGGCAACAATTAATAGACTGGATGGAGGCGGATAAAGTTGCAGGACCACTTCTGCGCTCGGCCCTTCCGGCTGGCTGGTTTAT<br>TGCTGATAAATCTGGAGCCGGTGAGCGTGGGTCTCGCGGTATCATTGCAGCACTGGGGCCAGATGGTAAGCCCTCCCGTATCGTAGTTATCTACACGA<br>CGGGGAGTCAGGCAACTATGGATGAACGAAATAGACAGATCGCTGAGATAGGTGCCTCACTGATTAAGCATTGGTAACTGTCAGACCAAGTTTACTCA<br>TATATACTTTAGATTGATTTAAAACTTCATTTTTAATTTAAAAGGATCTAGGTGAAGATCCTTTTTGATAATCTCATGACCAAAATCCCTTAACGTGA<br>GTTTTCGTTCCACTGAGCGTCAGACCCCGTAGAAAAGATCAAAGGATCTTCTTGAGATCCTTTTTTTCTGCGCGTAATCTGCTGCTTGCAAACAAAAA<br>AACCACCGCTACCAGCGGTGGTTTGTTTGCCGGATCAAGAGCTACCAACTCTTTTTCCGAAGGTAACTGGCTTCAGCAGAGCGCAGATACCAAATACT<br>GTCCTTCTAGTGTAGCCGTAGTTAGGCCACCACTTCAAGAACTCTGTAGCACCGCCTACATACCTCGCTCTGCTAATCCTGTTACCAGTGGCTGCTGC<br>CAGTGGCGATAAGTCGTGTCTTACCGGGTTGGACTCAAGACGATAGTTACCGGATAAGGCGCAGCGGTCGGGCTGAACGGGGGGTTCGTGCACACAGC<br>CCAGCTTGGAGCGAACGACCTACACCGAACTGAGATACCTACAGCGTGAGCATTGAGAAAGCGCCACGCTTCCCGAAGGGAGAAAGGCGGACAGGTAT<br>CCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTG<br>ACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGC<br>CTTTTGCTCACATGTTCTTTCCTGCGTTATCCCCTGATTCTGTGGATAACCGTATTACCGCCTTTGAGTGAGCTGATACCGCTCGCCGCAGCCGAACG<br>ACCGAGCGCAGCGAGTCAGTGAGCGAGGAAGCGGAAGAGCGCCTGATGCGGTATTTTCTCCTTACGCATCTGTGCGGTATTTCACACCGCAGACCAGC<br>CGCGTAACCTGGCAAAATCGGTTACGGTTGAGTAATAAATGGATGCCCTGCGTAAGCGGGTGTGGGCGGACAATAAAGTCTTAAACTGAACAAAATAG<br>ATCTAAACTATGACAATAAAGTCTTAAACTAGACAGAATAGTTGTAAACTGAAATCAGTCCAGTTATGCTGTGAAAAAGCATACTGGACTTTTGTTAT<br>GGCTAAAGCAAACTCTTCATTTTCTGAAGTGCAAATTGCCCGTCGTATTAAAGAGGGGCGTGGCCAAGGGCATGGTAAAGACTATATTCGCGGCGTTG<br>TGACAATTTACCGAACAACTCCGCGGCCGGGAAGCCGATCTCGGCTTGAACGAATTGTTAGGTGGCGGTACTTGGGTCGATATCAAAGTGCATCACTT<br>CTTCCCGTATGCCCAACTTTGTATAGAGAGCCACTGCGGGATCGTCACCGTAATCTGCTTGCACGTAGATCACATAAGCACCAAGCGCGTTGGCCTCA<br>TGCTTGAGGAGATTGATGAGCGCGGTGGCAATGCCCTGCCTCCGGTGCTCGCCGGAGACTGCGAGATCATAGATATAGATCTCACTACGCGGCTGCTC<br>AAACCTGGGCAGAACGTAAGCCGCGAGAGCGCCAACAACCGCTTCTTGGTCGAAGGCAGCAAGCGCGATGAATGTCTTACTACGGAGCAAGTTCCCGA<br>GGTAATCGGAGTCCGGCTGATGTTGGGAGTAGGTGGCTACGTCTCCGAACTCACGACCGAAAAGATCAAGAGCAGCCCGCATGGATTTGACTTGGTCA<br>GGGCCGAGCCTACATGTGCGAATGATGCCCATACTTGAGCCACCTAACTTTGTTTTAGGGCGACTGCCCTGCTGCGTAACATCGTTGCTGCTGCGTAA<br>CATCGTTGCTGCTCCATAACATCAAACATCGACCCACGGCGTAACGCGCTTGCTGCTTGGATGCCCGAGGCATAGACTGTACAAAAAAACAGTCATAA<br>CAAGCCATGAAAACCGCCACTGCGCCGTTACCACCGCTGCGTTCGGTCAAGGTTCTGGACCAGTTGCGTGAGCGCATACGCTACTTGCATTACAGTTT<br>ACGAACCGAACAGGCTTATGTCAACTGGGTTCGTGCCTTCATCCGTTTCCACGGTGTGCGTCACCCGGCAACCTTGGGCAGCAGCGAAGTCGAGGCAT<br>TTCTGTCCTGGCTGGCGAACGAGCGCAAGGTTTCGGTCTCCACGCATCGTCAGGCATTGGCGGCCTTGCTGTTCTTCTACGGCAAGGTGCTGTGCACG<br>GATCTGCCCTGGCTTCAGGAGATCGGAAGACCTCGGCCGTCGCGGCGCTTGCCGGTGGTGCTGACCCCGGATGAAGTGGTTCGCATCCTCGGTTTTCT<br>GGAAGGCGAGCATCGTTTGTTCGCCCAGGACTCTAGCTATAGTTCTAGTGGTTGGCTACGTATACTCCGGAATATTAATAGATCATGGAGATAATTAA<br>AATGATAACCATCTCGCAAATAAATAAGTATTTTACTGTTTTCGTAACAGTTTTGTAATAAAAAAACCTATAAATATTCCGGATTATTCATACCGTCC<br>CACCATCGGGCGCGGATCTCGGTCCGAAACCATGTCGTACTACCATCACCATCACCATCACGATTACGATATCCCAACGACCGAAAACCTGTATTTTC<br>AGGGCGCCATGGGATCCGGCCGGCCCCTGCAGGCAGCTGCGCGCTCGCTCGCTCACTGAGGCCGCCCGGGCAAAGCCCGGGCGTCGGGCGACCTTTGG<br>TCGCCCGGCCTCAGTGAGCGAGCGAGCGCGCAGAGAGGGAGTGGCCAACTCCATCACTAGGGGTTCCTTGTAGTTAATGATTAACCCGCCATGCTACT<br>TATCTACGTAGCCATGCTCTAGAGCGGCCGCAGGCTCAGAGGCACACAGGAGTTTCTGGGCTCACCCTGCCCCCTTCCAACCCCTCAGTTCCCATCCT<br>CCAGCAGCTGTTTGTGTGCTGCCTCTGAAGTCCACACTGAACAAACTTCAGCCTACTCATGTCCCTAAAATGGGCAAACATTGCAAGCAGCAAACAGC<br>AAACACACAGCCCTCCCTGCCTGCTGACCTTGGAGCTGGGGCAGAGGTCAGAGACCTCTCTGGGCCCATGCCACCTCCAACATCCACTCGACCCCTTG<br>GAATTTCGGTGGAGAGGAGCAGAGGTTGTCCTGGCGTGGTTTAGGTAGTGTGAGAGGGTCCGGGTTCAAAACCACTTGCTGGGTGGGGAGTCGTCAGT<br>AAGTGGCTATGCCCCGACCCCGAAGCCTGTTTCCCCATCTGTACAATGGAAATGATAAAGACGCCCATCTGATAGGGTTTTTGTGGCAAATAAACATT<br>TGGTTTTTTTGTTTTGTTTTGTTTTGTTTTTTGAGATGGAGGTTTGCTCTGTCGCCCAGGCTGGAGTGCAGTGACACAATCTCATCTCACCACAACCT |

TABLE 9-continued

| ceDNA Vector Name | Nucleic Acid Sequence |
| --- | --- |
| | TCCCCTGCCTCAGCCTCCCAAGTAGCTGGGATTACAAGCATGTGCCACCACACCTGGCTAATTTTCTATTTTTAGTAGAGACGGGTTTCTCCATGTTG<br>GTCAGCCTCAGCCTCCCAAGTAACTGGGATTACAGGCCTGTGCCACCACACCCGGCTAATTTTTTCTATTTTTGACAGGGACGGGGTTTCACCATGTT<br>GGTCAGGCTGGTCTAGAGGTACCG**GATCTTGCTACCAGTGGAACAGCCACTAAGGATTCTGCAGTGAGAGCAGAGGGCCAGCTAAGTGGTACTCTCCC**<br>**AGAGACTGTCTGACTCACGCCACCCCCTCCACCTTGGACACAGGACGCTGTGGTTTCTGAGCCAGGTACAATGACTCCTTTCGGTAAGTGCAGTGGAA**<br>**GCTGTACACTGCCCAGGCAAAGCGTCCGGGCAGCGTAGGCGGGCGACTCAGATCCCAGCCAGTGGACTTAGCCCCTGTTTGCT**CCTCCGATAACTGGG<br>GTGACCTTGGTTAATATTCACCAGCAGCCTCCCCCGTTGCCCCTCTGGATCCACTGCTTAAATACGGACGAGGACAGGGCCCTGTCTCCTCAGCTTCA<br>GGCACCACCACTGACCTGGGACAGTGAATCCGGACTCTAAGGTAAATATAAAATTTTTAAGTGTATAATGTGTTAAACTACTGATTCTAATTGTTTCT<br>CTCTTTTAGATTCCAACCTTTGGAACTGAGTTTAAACCGCAGCCACCATGCAGATCGAGCTGTCTACCTGCTTCTTCCTGTGCCTGCTGCGGTTCTGC<br>TTCAGCGCCACCAGAAGATATTACCTGGGCGCCGTGGAACTGAGCTGGGACTACATGCAGTCTGACCTGGGAGAGCTGCCCGTGGACGCTAGATTTCC<br>TCCAAGAGTGCCCAAGAGCTTCCCCTTCAACACCTCCGTGGTGTACAAGAAAACCCTGTTCGTGGAATTCACCGACCACCTGTTCAATATCGCCAAGC<br>CTCGGCCTCCTTGGATGGGACTGCTGGGACCTACAATTCAGGCCGAGGTGTACGACACCGTGGTCATCACCCTGAAGAACATGGCCAGCCATCCTGTG<br>TCTCTGCACGCCGTGGGAGTGTCTTATTGGAAGGCTTCTGAGGGCGCCGAGTACGACGATCAGACAAGCCAGAGAGAGAAAGAGGACGACAAGGTTTT<br>CCCTGGCGGCAGCCACACCTATGTCTGGCAGGTCCTGAAAGAAAACGGCCCTATGGCCTCCGATCCTCTGTGCCTGACATACAGCTACCTGAGCCACG<br>TGGACCTGGTCAAGGACCTGAATTCTGGCCTGATCGGAGCCCTGCTCGTGTGTAGAGAAGGCAGCCTGGCCAAAGAGAAAACCCAGACACTGCACAAG<br>TTCATCCTGCTGTTCGCCGTGTTCGACGAGGGCAAGAGCTGGCACAGCGAGACAAAGAACAGCCTGATGCAGGACAGGGATGCCGCCTCTGCTAGAGC<br>TTGGCCTAAGATGCACACCGTGAACGGCTACGTGAACAGAAGCCTGCCTGGACTGATCGGCTGCCACAGAAAGTCCGTGTACTGGCACGTGATCGGCA<br>TGGGCACAACACCTGAGGTGCACAGCATCTTTCTGGAAGGCCACACCTTCCTCGTGCGGAACCACAGACAGGCCAGCCTGGAAATCAGCCCTATCACC<br>TTCCTGACCGCTCAGACCCTGCTGATGGATCTGGGCCAGTTTCTGCTGTTCTGCCACATCAGCTCCCACCAGCACGATGGCATGGAAGCCTACGTGAA<br>GGTGGACAGCTGCCCCGAAGAACCCCAGCTGCGGATGAAGAACAACGAGGAAGCCGAGGACTACGACGACGACCTGACCGACTCTGAGATGGACGTCG<br>TCAGATTCGACGACGATAACAGCCCCAGCTTCATCCAGATCAGAAGCGTGGCCAAGAAGCACCCCAAGACCTGGGTGCACTATATCGCCGCCGAGGAA<br>GAGGACTGGGATTACGCTCCTCTGGTGCTGGCCCCTGACGACAGAAGCTACAAGAGCCAGTACCTGAACAACGGCCCTCAGCGGATCGGCCGGAAGTA<br>TAAGAAAGTGCGGTTCATGGCCTACACCGACGAGACATTCAAGACCAGAGAGGCCATCCAGCACGAGAGCGGAATTCTGGGCCCTCTGCTGTATGGCG<br>AAGTGGGCGATACACTGCTGATCATCTTCAAGAACCAGGCCAGCAGACCCTACAACATCTACCCTCACGGCATCACCGATGTGCGGCCCCTGTATTCT<br>AGAAGGCTGCCCAAGGGCGTGAAGCACCTGAAGGACTTCCCTATCCTGCCTGGCGAGATTTTCAAGTACAAGTGGACCGTGACCGTGGAAGATGGCCC<br>CACCAAGAGCGACCCTAGATGTCTGACACGGTACTACAGCAGCTTCGTGAACATGGAACGCGACCTGGCCAGCGGCCTGATTGGACCTCTGCTGATCT<br>GCTACAAAGAAAGCGTGGACCAGCGGGGCAACCAGATCATGAGCGACAAGCGGAACGTGATCCTGTTTAGCGTGTTCGATGAGAACCGGTCCTGGTAT<br>CTGACCGAGAACATCCAGCGGTTTCTGCCCAATCCTGCCGGGGTGCAACTGGAAGATCCTGAGTTCCAGGCAAGCAACATCATGCACTCCATCAATGG<br>CTATGTGTTCGACAGCCTGCAGCTGAGCGTGTGCCTGCACGAAGTGGCCTACTGGTACATCCTGAGCATTGGCGCCCAGACCGACTTCCTGTCCGTGT<br>TCTTTAGCGGCTACACCTTCAAGCACAAGATGGTGTACGAGGATACCCTGACACTGTTCCCATTCAGCGGCGAGACAGTGTTCATGAGCATGGAAAAC<br>CCCGGCCTGTGGATTCTGGGCTGTCACAACAGCGACTTCCGGAACAGAGGCATGACAGCCCTGCTGAAGGTGTCCAGCTGCGACAAGAACACCGGCGA<br>CTACTACGAGGACAGCTATGAGGACATCAGCGCCTACCTGCTGAGCAAGAACAATGCCATCGAGCCTCGGAGCTTCAGCCAGAATCCTCCTGTGCTGA<br>AGCGGCACCAGCGCGAGATCACCAGAACAACCCTGCAGAGCGACCAAGAGGAAATCGATTACGACGACACCATCAGCGTCGAGATGAAGAAAGAAGAT<br>TTCGACATCTACGACGAGGACGAGAATCAGAGCCCCAGAAGCTTTCAGAAAAAGACCCGGCACTACTTCATTGCCGCCGTCGAGAGACTGTGGGACTA<br>CGGCATGTCTAGCAGCCCTCACGTGCTGAGAAATAGAGCCCAGAGCGGCAGCGTGCCCCAGTTCAAGAAAGTGGTGTTCCAAGAGTTCACCGACGGCA<br>GCTTCACCCAGCCACTGTATAGAGGCGAGCTGAACGAGCATCTGGGCCTGCTGGGCCCTTATATCAGAGCCGAAGTGGAAGATAACATCATGGTCACC<br>TTCCGGAATCAGGCTAGCCGGCCTTACAGCTTCTACAGCTCCCTGATCAGCTACGAAGAGGACCAGAGACAGGGCGCTGAGCCCAGAAAGAACTTCGT<br>GAAGCCCAACGAGACTAAGACCTACTTTTGGAAGGTGCAGCACCACATGGCCCCTACAAAGGACGAGTTCGACTGCAAAGCCTGGGCCTACTTCTCCG<br>ATGTGGATCTGGAAAAGGACGTGCACAGCGGGCTCATCGGACCACTGCTTGTGTGCCACACCAACACACTGAACCCCGCTCACGGCAGACAAGTGACA<br>GTGCAAGAGTTCGCCCTGTTCTTCACCATCTTCGACGAAACAAAGAGCTGGTACTTCACCGAGAATATGGAACGGAACTGCAGAGCCCCTTGCAACAT<br>CCAGATGGAAGATCCCACCTTCAAAGAGAACTACCGGTTCCACGCCATCAACGGCTACATCATGGACACACTGCCCGGCCTGGTTATGGCCCAGGATC<br>AGAGAATCCGGTGGTATCTGCTGTCCATGGGCTCCAACGAGAATATCCACAGCATCCACTTCAGCGGCCACGTGTTCACCGTGCGGAAAAAAGAAGAG<br>TACAAAATGGCCCTGTACAATCTGTACCCTGGGGTGTTCGAAACCGTGGAAATGCTGCCTTCCAAGGCCGGCATTTGGAGAGTGGAATGTCTGATTGG<br>AGAGCACCTCCACGCCGGAATGAGCACCCTGTTTCTGGTGTACAGCAACAAGTGTCAGACCCCTCTCGGCATGGCCTCTGGACACATCAGAGACTTCC<br>AGATCACCGCCTCTGGCCAGTACGGACAGTGGGCTCCTAAACTGGCTCGGCTGCACTACAGCGGCAGCATCAATGCCTGGTCCACCAAAGAGCCCTTC<br>AGCTGGATCAAGGTGGACCTGCTGGCTCCCATGATCATCCACGGAATCAAGACCCAGGGCGCCAGACAGAAGTTCAGCAGCCTGTACATCAGCCAGTT<br>CATCATCATGTACAGCCTGGACGGCAAGAAGTGGCAGACCTACAGAGGCAACAGCACCGGCACACTCATGGTGTTCTTCGGCAACGTGGACTCCAGCG<br>GCATTAAGCACAACATCTTCAACCCTCCAATCATTGCCCGGTACATCCGGCTGCACCCCACACACTACAGCATCCGGTCTACCCTGAGAATGGAACTG<br>ATGGGCTGCGACCTGAACAGCTGCTCTATGCCCCTCGGAATGGAAAGCAAGGCCATCAGCGACGCCCAGATCACAGCCAGCAGCTACTTCACCAACAT<br>GTTCGCCACTTGGAGCCCCTCCAAGGCTAGACTGCATCTGCAGGGCAGAAGCAACGCTTGGAGGCCCCAAGTGAACAACCCCAAAGAGTGGCTGCAGG<br>TTGACTTTCAAAAGACCATGAAAGTGACCGGCGTGACCACACAGGGCGTCAAGTCTCTGCTGACCTCTATGTACGTGAAAGAGTTCCTGATCTCCAGC |

TABLE 9-continued

| ceDNA Vector Name | Nucleic Acid Sequence |
|---|---|
| | AGCCAGGACGGCCATCAGTGGACCCTGTTTTTCCAGAACGGCAAAGTGAAAGTGTTCCAGGGCAATCAGGACAGCTTCACACCCGTGGTCAATTCTCT<br>GGACCCTCCACTGCTGACCAGATACCTGCGGATTCACCCTCAGTCTTGGGTGCACCAGATCGCTCTGCGGATGGAAGTGCTGGGCTGTGAAGCTCAGG<br>ACCTCTACTAGTTAATTAAGAGCATCTTACCGCCATTTATTCCCATATTTGTTCTGTTTTTCTTGATTTGGGTATACATTTAAATGTTAATAAAACAA<br>AATGGTGGGGCAATCATTTACATTTTTAGGGATATGTAATTACTAGTTCAGGTGTATTGCCACAAGACAAACATGTTAAGAAACTTTCCCGTTATTTA<br>CGCTCTGTTCCTGTTAATCAACCTCTGGATTACAAAATTTGTGAAAGATTGACTGATATTCTTAACTATGTTGCTCCTTTTACGCTGTGTGGATATGC<br>TGCTTTATAGCCTCTGTATCTAGCTATTGCTTCCCGTACGGCTTTCGTTTTCTCCTCCTTGTATAAATCCTGGTTGCTGTCTCTTTTAGAGGAGTTGT<br>GGCCCGTTGTCCGTCAACGTGGCGTGGTGTGCTCTGTGTTTGCTGACGCAACCCCCACTGGCTGGGGCATTGCCACCACCTGTCAACTCCTTTCTGGG<br>ACTTTCGCTTTCCCCCTCCCGATCGCCACGGCAGAACTCATCGCCGCCTGCCTTGCCCGCTGCTGGACAGGGGCTAGGTTGCTGGGCACTGATAATTC<br>CGTGGTGTTGTCTGTGCCTTCTAGTTGCCAGCCATCTGTTGTTTGCCCCTCCCCCGTGCCTTCCTTGACCCTGGAAGGTGCCACTCCCACTGTCCTTT<br>CCTAATAAAATGAGGAAATTGCATCGCATTGTCTGAGTAGGTGTCATTCTATTCTGGGGGGTGGGGTGGGGCAGGACAGCAAGGGGGAGGATTGGGAA<br>GACAATAGCAGGCATGCTGGGGATGCGGTGGGCTCTATGGCTCTAGAGCATGGCTACGTAGATAAGTAGCATGGCGGGTTAATCATTAACTACACCTG<br>CAGGAGGAACCCCTAGTGATGGAGTTGGCCACTCCCTCTCTGCGCGCTCGCTCGCTCACTGAGGCCGGGCGACCAAAGGTCGCCCGACGCCCGGGCGG<br>CCTCAGTGAGCGAGCGAGCGCGCAGCTGCCTGCAGGGGCGCGCCTCGAGGCATGCGGTACCAAGCTTGTCGAGAAGTACTAGAGGATCATAATCAGCC<br>ATACCACATTTGTAGAGGTTTTACTTGCTTTAAAAAACCTCCCACACCTCCCCCTGAACCTGAAACATAAAATGAATGCAATTGTTGTTGTTAACTTG<br>TTTATTGCAGCTTATAATGGTTACAAATAAAGCAATAGCATCACAAATTTCACAAATAAAGCATTTTTTTCACTGCATTCTAGTTGTGGTTTGTCCAA<br>ACTCATCAATGTATCTTATCATGTCTGGATCTGATCACTGATATCGCCTAGGAGATCCGAACCAGATAAGTGAAATCTAGTTCCAAACTATTTTGTCA<br>TTTTTAATTTTCGTATTAGCTTACGACGCTACACCCAGTTCCCATCTATTTTGTCACTCTTCCCTAAATAATCCTTAAAAACTCCATTTCCACCCCTC<br>CCAGTTCCCAACTATTTTGTCCGCCCACAGCGGGGCATTTTTCTTCCTGTTATGTTTTTAATCAAACATCCTGCCAACTCCATGTGACAAACCGTCAT<br>CTTCGGCTACTTTTTCTCTGTCACAGAATGAAAATTTTTCTGTCATCTCTTCGTTATTAATGTTTGTAATTGACTGAATATCAACGCTTATTTGCAGC<br>CTGAATGGCGAATGG |
| ceDNAFVIII-vector 3 (SEQ ID NO: 194) | GACGCGCCCTGTAGCGGCGCATTAAGCGCGGCGGGTGTGGTGGTTACGCGCAGCGTGACCGCTACACTTGCCAGCGCCCTAGCGCCCGCTCCTTTCGC<br>TTTCTTCCCTTCCTTTCTCGCCACGTTCGCCGGCTTTCCCCGTCAAGCTCTAAATCGGGGGCTCCCTTTAGGGTTCCGATTTAGTGCTTTACGGCACC<br>TCGACCCCAAAAAACTTGATTAGGGTGATGGTTCACGTAGTGGGCCATCGCCCTGATAGACGGTTTTTCGCCCTTTGACGTTGGAGTCCACGTTCTTT<br>AATAGTGGACTCTTGTTCCAAACTGGAACAACACTCAACCCTATCTCGGTCTATTCTTTTGATTTATAAGGGATTTTGCCGATTTCGGCCTATTGGTT<br>AAAAAATGAGCTGATTTAACAAAAATTTAACGCGAATTTTAACAAAATATTAACGTTTACAATTTCAGGTGGCACTTTTCGGGGAAATGTGCGCGGAA<br>CCCCTATTTGTTTATTTTTCTAAATACATTCAAATATGTATCCGCTCATGAGACAATAACCCTGATAAATGCTTCAATAATATTGAAAAAGGAAGAGT<br>ATGAGTATTCAACATTTCCGTGTCGCCCTTATTCCCTTTTTTGCGGCATTTTGCCTTCCTGTTTTTGCTCACCCAGAAACGCTGGTGAAAGTAAAAGA<br>TGCTGAAGATCAGTTGGGTGCACGAGTGGGTTACATCGAACTGGATCTCAACAGCGGTAAGATCCTTGAGAGTTTTCGCCCCGAAGAACGTTTTCCAA<br>TGATGAGCACTTTTAAAGTTCTGCTATGTGGCGCGGTATTATCCCGTATTGACGCCGGGCAAGAGCAACTCGGTCGCCGCATACACTATTCTCAGAAT<br>GACTTGGTTGAGTACTCACCAGTCACAGAAAAGCATCTTACGGATGGCATGACAGTAAGAGAATTATGCAGTGCTGCCATAACCATGAGTGATAACAC<br>TGCGGCCAACTTACTTCTGACAACGATCGGAGGACCGAAGGAGCTAACCGCTTTTTTGCACAACATGGGGGATCATGTAACTCGCCTTGATCGTTGGG<br>AACCGGAGCTGAATGAAGCCATACCAAACGACGAGCGTGACACCACGATGCCTGTAGCAATGGCAACAACGTTGCGCAAACTATTAACTGGCGAACTA<br>CTTACTCTAGCTTCCCGGCAACAATTAATAGACTGGATGGAGGCGGATAAAGTTGCAGGACCACTTCTGCGCTCGGCCCTTCCGGCTGGCTGGTTTAT<br>TGCTGATAAATCTGGAGCCGGTGAGCGTGGGTCTCGCGGTATCATTGCAGCACTGGGGCCAGATGGTAAGCCCTCCCGTATCGTAGTTATCTACACGA<br>CGGGGAGTCAGGCAACTATGGATGAACGAAATAGACAGATCGCTGAGATAGGTGCCTCACTGATTAAGCATTGGTAACTGTCAGACCAAGTTTACTCA<br>TATATACTTTAGATTGATTTAAAACTTCATTTTTAATTTAAAAGGATCTAGGTGAAGATCCTTTTTGATAATCTCATGACCAAAATCCCTTAACGTGA<br>GTTTTCGTTCCACTGAGCGTCAGACCCCGTAGAAAAGATCAAAGGATCTTCTTGAGATCCTTTTTTTCTGCGCGTAATCTGCTGCTTGCAAACAAAAA<br>AACCACCGCTACCAGCGGTGGTTTGTTTGCCGGATCAAGAGCTACCAACTCTTTTTCCGAAGGTAACTGGCTTCAGCAGAGCGCAGATACCAAATACT<br>GTCCTTCTAGTGTAGCCGTAGTTAGGCCACCACTTCAAGAACTCTGTAGCACCGCCTACATACCTCGCTCTGCTAATCCTGTTACCAGTGGCTGCTGC<br>CAGTGGCGATAAGTCGTGTCTTACCGGGTTGGACTCAAGACGATAGTTACCGGATAAGGCGCAGCGGTCGGGCTGAACGGGGGGTTCGTGCACACAGC<br>CCAGCTTGGAGCGAACGACCTACACCGAACTGAGATACCTACAGCGTGAGCATTGAGAAAGCGCCACGCTTCCCGAAGGGAGAAAGGCGGACAGGTAT<br>CCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTG<br>ACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGC<br>CTTTTGCTCACATGTTCTTTCCTGCGTTATCCCCTGATTCTGTGGATAACCGTATTACCGCCTTTGAGTGAGCTGATACCGCTCGCCGCAGCCGAACG<br>ACCGAGCGCAGCGAGTCAGTGAGCGAGGAAGCGGAAGAGCGCCTGATGCGGTATTTTCTCCTTACGCATCTGTGCGGTATTTCACACCGCAGACCAGC<br>CGCGTAACCTGGCAAAATCGGTTACGGTTGAGTAATAAATGGATGCCCTGCGTAAGCGGGTGTGGGCGGACAATAAAGTCTTAAACTGAACAAAATAG<br>ATCTAAACTATGACAATAAAGTCTTAAACTAGACAGAATAGTTGTAAACTGAAATCAGTCCAGTTATGCTGTGAAAAAGCATACTGGACTTTTGTTAT<br>GGCTAAAGCAAACTCTTCATTTTCTGAAGTGCAAATTGCCCGTCGTATTAAAGAGGGGCGTGGCCAAGGGCATGGTAAAGACTATATTCGCGGCGTTG<br>TGACAATTTACCGAACAACTCCGCGGCCGGGAAGCCGATCTCGGCTTGAACGAATTGTTAGGTGGCGGTACTTGGGTCGATATCAAAGTGCATCACTT |

TABLE 9-continued

| ceDNA Vector Name | Nucleic Acid Sequence |
|---|---|
| | CTTCCCGTATGCCCAACTTTGTATAGAGAGCCACTGCGGGATCGTCACCGTAATCTGCTTGCACGTAGATCACATAAGCACCAAGCGCGTTGGCCTCA<br>TGCTTGAGGAGATTGATGAGCGCGGTGGCAATGCCCTGCCTCCGGTGCTCGCCGGAGACTGCGAGATCATAGATATAGATCTCACTACGCGGCTGCTC<br>AAACCTGGGCAGAACGTAAGCCGCGAGAGCGCCAACAACCGCTTCTTGGTCGAAGGCAGCAAGCGCGATGAATGTCTTACTACGGAGCAAGTTCCCGA<br>GGTAATCGGAGTCCGGCTGATGTTGGGAGTAGGTGGCTACGTCTCCGAACTCACGACCGAAAAGATCAAGAGCAGCCCGCATGGATTTGACTTGGTCA<br>GGGCCGAGCCTACATGTGCGAATGATGCCCATACTTGAGCCACCTAACTTTGTTTTAGGGCGACTGCCCTGCTGCGTAACATCGTTGCTGCTGCGTAA<br>CATCGTTGCTGCTCCATAACATCAAACATCGACCCACGGCGTAACGCGCTTGCTGCTTGGATGCCCGAGGCATAGACTGTACAAAAAAACAGTCATAA<br>CAAGCCATGAAAACCGCCACTGCGCCGTTACCACCGCTGCGTTCGGTCAAGGTTCTGGACCAGTTGCGTGAGCGCATACGCTACTTGCATTACAGTTT<br>ACGAACCGAACAGGCTTATGTCAACTGGGTTCGTGCCTTCATCCGTTTCCACGGTGTGCGTCACCCGGCAACCTTGGGCAGCAGCGAAGTCGAGGCAT<br>TTCTGTCCTGGCTGGCGAACGAGCGCAAGGTTTCGGTCTCCACGCATCGTCAGGCATTGGCGGCCTTGCTGTTCTTCTACGGCAAGGTGCTGTGCACG<br>GATCTGCCCTGGCTTCAGGAGATCGGAAGACCTCGGCCGTCGCGGCGCTTGCCGGTGGTGCTGACCCCGGATGAAGTGGTTCGCATCCTCGGTTTTCT<br>GGAAGGCGAGCATCGTTTGTTCGCCCAGGACTCTAGCTATAGTTCTAGTGGTTGGCTACGTATACTCCGGAATATTAATAGATCATGGAGATAATTAA<br>AATGATAACCATCTCGCAAATAAATAAGTATTTTACTGTTTTCGTAACAGTTTTGTAATAAAAAAACCTATAAATATTCCGGATTATTCATACCGTCC<br>CACCATCGGGCGCGGATCTCGGTCCGAAACCATGTCGTACTACCATCACCATCACCATCACGATTACGATATCCCAACGACCGAAAACCTGTATTTTC<br>AGGGCGCCATGGGATCCGGCCGGCCCCTGCAGGCAGCTGCGCGCTCGCTCGCTCACTGAGGCCGCCCGGGCAAAGCCCGGGCGTCGGGCGACCTTTGG<br>TCGCCCGGCCTCAGTGAGCGAGCGAGCGCGCAGAGAGGGAGTGGCCAACTCCATCACTAGGGGTTCCTTGTAGTTAATGATTAACCCGCCATGCTACT<br>TATCTACGTAGCCATGCTCTAGAGCGGCCGCCCCTAAAATGGGCAAACATTGCAAGCAGCAAACAGCAAACACACAGCCCTCCCTGCCTGCTGACCTT<br>GGAGCTGGGGCAGAGGTCAGAGACCTCTCTGGGCCCATGCCACCTCCAACATCCACTCGACCCCTTGGAATTTTTCGGTGGAGAGGAGCAGAGGTTGT<br>CCTGGCGTGGTTTAGGTAGTGTGAGAGGG**GAATGACTCCTTTCGGTAAGTGCAGTGGAAGCTGTACACTGCCCAGGCAAAGCGTCCGGGCAGCGTAGG**<br>**CGGGCGACTCAGATCCCAGCCAGTGGACTTAGCCCCTGTTTGCTCCTCCGATAACTGGGGTGACCTTGGTTAATATTCACCAGCAGCCTCCCCCGTTG**<br>**CCCCTCTGGATCCACTGCTTAAATACGGACGAGGACAGG**GCCCTGTCTCCTCAGCTTCAGGCACCACCACTGACCTGGGACAGTGAATCCGGACTCTA<br>AGGTAAATATAAAATTTTTAAGTGTATAATGTGTTAAACTACTGATTCTAATTGTTTCTCTCTTTTAGATTCCAACCTTTGGAACTGAGTTTAAACCG<br>CAGCCACCATGCAGATCGAGCTGTCTACCTGCTTCTTCCTGTGCCTGCTGCGGTTCTGCTTCAGCGCCACCAGAAGATATTACCTGGGCGCCGTGGAA<br>CTGAGCTGGGACTACATGCAGTCTGACCTGGGAGAGCTGCCCGTGGACGCTAGATTTCCTCCAAGAGTGCCCAAGAGCTTCCCCTTCAACACCTCCGT<br>GGTGTACAAGAAAACCCTGTTCGTGGAATTCACCGACCACCTGTTCAATATCGCCAAGCCTCGGCCTCCTTGGATGGACTGCTGGGACCTACAATTC<br>AGGCCGAGGTGTACGACACCGTGGTCATCACCCTGAAGAACATGGCCAGCCATCCTGTGTCTCTGCACGCCGTGGGAGTGTCTTATTGGAAGGCTTCT<br>GAGGGCGCCGAGTACGACGATCAGACAAGCCAGAGAGAGAAAGAGGACGACAAGGTTTTCCCTGGCGGCAGCCACACCTATGTCTGGCAGGTCCTGAA<br>AGAAAACGGCCCTATGGCCTCCGATCCTCTGTGCCTGACATACAGCTACCTGAGCCACGTGGACCTGGTCAAGGACCTGAATTCTGGCCTGATCGGAG<br>CCCTGCTCGTGTGTAGAGAAGGCAGCCTGGCCAAAGAGAAAACCCAGACACTGCACAAGTTCATCCTGCTGTTCGCCGTGTTCGACGAGGGCAAGAGC<br>TGGCACAGCGAGACAAAGAACAGCCTGATGCAGGACAGGGATGCCGCCTCTGCTAGAGCTTGGCCTAAGATGCACACCGTGAACGGCTACGTGAACAG<br>AAGCCTGCCTGGACTGATCGGCTGCCACAGAAAGTCCGTGTACTGGCACGTGATCGGCATGGGCACAACACCTGAGGTGCACAGCATCTTTCTGGAAG<br>GCCACACCTTCCTCGTGCGGAACCACAGACAGGCCAGCCTGGAAATCAGCCCTATCACCTTCCTGACCGCTCAGACCCTGCTGATGGATCTGGGCCAG<br>TTTCTGCTGTTCTGCCACATCAGCTCCCACCAGCACGATGGCATGGAAGCCTACGTGAAGGTGGACAGCTGCCCCGAAGAACCCCAGCTGCGGATGAA<br>GAACAACGAGGAAGCCGAGGACTACGACGACGACCTGACCGACTCTGAGATGGACGTCGTCAGATTCGACGACGATAACAGCCCCAGCTTCATCCAGA<br>TCAGAAGCGTGGCCAAGAAGCACCCCAAGACCTGGGTGCACTATATCGCCGCCGAGGAAGAGGACTGGGATTACGCTCCTCTGGTGCTGGCCCCTGAC<br>GACAGAAGCTACAAGAGCCAGTACCTGAACAACGGCCCTCAGCGGATCGGCCGGAAGTATAAGAAAGTGCGGTTCATGGCCTACACCGACGAGACATT<br>CAAGACCAGAGAGGCCATCCAGCACGAGAGCGGAATTCTGGGCCCTCTGCTGTATGGCGAAGTGGGCGATACACTGCTGATCATCTTCAAGAACCAGG<br>CCAGCAGACCCTACAACATCTACCCTCACGGCATCACCGATGTGCGGCCCCTGTATTCTAGAAGGCTGCCCAAGGGCGTGAAGCACCTGAAGGACTTC<br>CCTATCCTGCCTGGCGAGATTTTCAAGTACAAGTGGACCGTGACCGTGGAAGATGGCCCCACCAAGAGCGACCCTAGATGTCTGACACGGTACTACAG<br>CAGCTTCGTGAACATGGAACGCGACCTGGCCAGCGGCCTGATTGGACCTCTGCTGATCTGCTACAAAGAAAGCGTGGACCAGCGGGGCAACCAGATCA<br>TGAGCGACAAGCGGAACGTGATCCTGTTTAGCGTGTTCGATGAGAACCGGTCCTGGTATCTGACCGAGAACATCCAGCGGTTTCTGCCCAATCCTGCC<br>GGGGTGCAACTGGAAGATCCTGAGTTCCAGGCAAGCAACATCATGCACTCCATCAATGGCTATGTGTTCGACAGCCTGCAGCTGAGCGTGTGCCTGCA<br>CGAAGTGGCCTACTGGTACATCCTGAGCATTGGCGCCCAGACCGACTTCCTGTCCGTGTTCTTTAGCGGCTACACCTTCAAGCACAAGATGGTGTACG<br>AGGATACCCTGACACTGTTCCCATTCAGCGGCGAGACAGTGTTCATGAGCATGGAAAACCCCGGCCTGTGGATTCTGGGCTGTCACAACAGCGACTTC<br>CGGAACAGAGGCATGACAGCCCTGCTGAAGGTGTCCAGCTGCGACAAGAACACCGGCGACTACTACGAGGACAGCTATGAGGACATCAGCGCCTACCT<br>GCTGAGCAAGAACAATGCCATCGAGCCCAGAAGCTTCAGCCAGAATAGCAGACACCCCTCCACCAGACAGAAGCAGTTCAACGCCACAACAATCCCCG<br>AGAACGACATCGAGAAAACCGATCCTTGGTTTGCCCACAGAACCCCTATGCCTAAGATCCAGAACGTGTCCTCCAGCGATCTGCTGATGCTCCTGAGA<br>CAGAGCCCTACACCTCACGGACTGAGCCTGTCCGATCTGCAAGAGGCCAAATACGAAACCTTCAGCGACGACCCTTCTCCTGGCGCCATCGACAGCAA<br>CAATAGCCTGAGCGAGATGACCCACTTCAGACCACAGCTGCACCACAGCGGCGACATGGTGTTTACACCTGAGAGCGGCCTCCAGCTGAGACTGAATG<br>AGAAGCTGGGAACCACCGCCGCCACCGAGCTGAAGAAACTGGACTTCAAGGTGTCCTCTACCAGCAACAACCTGATCAGCACAATCCCCTCCGACAAC<br>CTGGCTGCCGGCACCGACAACACATCTTCTCTGGGCCCACCTAGCATGCCCGTGCACTACGATAGCCAGCTGGATACCACACTGTTCGGCAAGAAGTC |

TABLE 9-continued

| ceDNA Vector Name | Nucleic Acid Sequence |
|---|---|
| | TAGCCCTCTGACAGAGTCTGGCGGCCCTCTGTCTCTGAGCGAGGAAAACAACGACAGCAAGCTGCTGGAATCCGGCCTGATGAACAGCCAAGAGTCCT<br>CCTGGGGCAAGAATGTGTCCAGCACCGAGTCCGGCAGACTGTTCAAGGGAAAGAGAGCCCACGGACCTGCTCTGCTGACCAAGGATAACGCCCTGTTC<br>AAAGTGTCCATCAGCCTGCTCAAGACCAACAAGACCTCCAACAACTCCGCCACCAACAGAAAGACCCACATCGACGGCCCTAGCCTGCTGATCGAGAA<br>TAGCCCTAGCGTCTGGCAGAATATCCTGGAAAGCGACACCGAGTTCAAGAAAGTGACCCCTCTGATCCACGACCGGATGCTCATGGACAAGAACGCCA<br>CCGCTCTGCGGCTGAACCACATGAGCAACAAGACAACCAGCAGCAAGAATATGGAAATGGTGCAGCAGAAGAAAGAGGGCCCCATTCCTCCAGACGCT<br>CAGAACCCCGATATGAGCTTCTTCAAGATGCTCTTTCTGCCCGAGAGCGCCCGGTGGATTCAGAGAACACACGGCAAGAACTCCCTGAACTCCGGCCA<br>GGGACCTTCTCCAAAGCAGCTGGTTTCCCTGGGACCTGAGAAGTCCGTGGAAGGACAGAACTTCCTGAGCGAAAAGAACAAAGTGGTCGTCGGCAAGG<br>GCGAGTTCACCAAGGATGTGGGCCTGAAAGAGATGGTCTTTCCCAGCAGCCGGAACCTGTTCCTGACCAACCTGGACAACCTGCACGAGAACAACACC<br>CACAATCAAGAGAAGAAGATCCAAGAGGAAATCGAAAAGAAAGAGACACTCATCCAAGAGAACGTGGTGCTGCCTCAGATCCACACAGTGACCGGCAC<br>CAAGAACTTTATGAAGAATCTGTTCCTGCTGAGTACCCGGCAGAACGTGGAAGGCAGCTACGATGGCGCTTATGCCCCTGTGCTGCAGGACTTCAGAT<br>CCCTGAACGACTCCACCAATCGGACAAAGAAGCACACAGCCCACTTCTCCAAGAAGGGCGAAGAAGAGAACCTGGAAGGACTGGGCAATCAGACCAAG<br>CAGATCGTCGAGAAGTACGCCTGCACCACCAGAATCAGCCCCAACACAAGCCAGCAGAACTTCGTGACCCAGCGGAGCAAAAGAGCCCTGAAGCAGTT<br>TCGGCTGCCCCTGGAAGAAACCGAGCTGGAAAAGCGGATCATCGTGGACGACACCAGCACACAGTGGTCCAAGAACATGAAGCACTTGACCCCTAGCA<br>CACTGACCCAGATCGACTACAACGAGAAAGAGAAGGGCGCTATCACACAGAGCCCACTGAGCGACTGTCTGACCAGAAGCCACAGCATCCCTCAGGCC<br>AACAGATCCCCTCTGCCAATCGCCAAAGTGTCTAGCTTCCCCAGCATCAGACCCATCTACCTGACCAGAGTGCTGTTCCAGGACAACAGCAGCCATCT<br>GCCAGCCGCCAGCTACCGGAAGAAAGATTCTGGCGTGCAAGAGAGCAGCCACTTTCTGCAGGGCGCTAAGAAGAACAATCTGAGCCTGGCTATTCTGA<br>CCCTGGAAATGACCGGCGATCAGAGAGAAGTCGGCTCTCTGGGCACCAGCGCCACAAATAGCGTGACCTACAAAAAGGTGGAAAACACCGTGCTGCCT<br>AAGCCTGACCTGCCAAAGACAAGCGGCAAGGTGGAACTGCTGCCAAAGGTGCACATCTACCAGAAGGACCTGTTTCCTACCGAGACAAGCAACGGCTC<br>TCCCGGCCATCTGGATCTGGTGGAAGGATCTCTGCTGCAGGGAACCGAGGGCGCCATCAAGTGGAACGAGGCCAATAGACCTGGCAAGGTGCCCTTCC<br>TGAGAGTGGCCACAGAGTCCAGCGCCAAGACACCCTCTAAACTGCTGGACCCTCTGGCCTGGGACAACCACTATGGCACTCAGATCCCCAAAGAGGAA<br>TGGAAGTCCCAAGAGAAGTCCCCTGAAAAGACCGCCTTCAAGAAGAAGGACACCATTCTGTCCCTGAATGCCTGCGAGAGCAACCACGCCATTGCCGC<br>CATCAATGAGGGCCAGAACAAGCCCGAGATCGAAGTGACCTGGGCCAAGCAGGGAAGAACCGAGAGACTGTGTAGCCAGAATCCTCCTGTGCTGAAGC<br>GGCACCAGAGAGAAATCACCCGGACCACACTGCAGAGCGACCAAGAAGAGATCGATTACGACGATACCATCAGCGTCGAGATGAAGAAAGAAGATTTC<br>GACATCTACGACGAGGACGAGAATCAGAGCCCTCGGAGCTTCCAGAAGAAAACCAGGCACTACTTTATTGCCGCCGTCGAGCGGCTGTGGGACTACGG<br>AATGTCTAGCTCTCCTCACGTGCTGCGGAATAGAGCCCAGTCTGGTAGCGTGCCCCAGTTCAAAAAGGTCGTGTTCCAAGAGTTCACCGACGGCAGCT<br>TCACCCAGCCACTGTATAGAGGCGAGCTGAACGAGCATCTGGGCCTGCTGGGCCCTTATATCAGAGCCGAAGTGGAAGATAACATCATGGTCACCTTC<br>CGGAATCAGGCTAGCCGGCCTTACAGCTTCTACAGCTCCCTGATCTCCTACGAAGAGGACCAGAGACAGGGCGCAGAGCCCCGGAAGAATTTCGTGAA<br>GCCCAACGAGACTAAGACCTACTTTTGGAAGGTGCAGCACCATATGGCCCCTACAAAGGACGAGTTCGACTGCAAAGCCTGGGCCTACTTCTCCGATG<br>TGGACCTCGAAAAGGACGTGCACAGCGGACTCATCGGCCCACTGCTTGTGTGCCACACCAACACACTGAACCCCGCTCACGGCAGACAAGTGACAGTG<br>CAAGAGTTCGCCCTGTTTTTCACCATCTTCGACGAAACGAAGTCCTGGTACTTCACCGAAAACATGGAAAGAAACTGCAGGGCCCCTTGCAACATTCA<br>GATGGAAGATCCCACCTTCAAAGAGAACTACCGGTTCCACGCCATCAACGGCTACATCATGGACACACTGCCCGGCCTGGTTATGGCCCAGGATCAGA<br>GAATCCGGTGGTATCTGCTGTCCATGGGCTCCAACGAGAATATCCACTCCATCCACTTCAGCGGCCACGTGTTCACCGTGCGGAAAAAAGAAGAGTAC<br>AAAATGGCCCTGTACAATCTGTACCCTGGGGTGTTCGAAACCGTTGAGATGCTGCCTAGCAAGGCCGGAATTTGGAGAGTGGAATGTCTGATTGGAGA<br>GCACCTCCACGCCGGGATGAGCACCCTGTTTCTGGTGTACTCCAACAAGTGTCAGACCCCTCTCGGCATGGCCTCTGGCCACATTAGAGACTTCCAGA<br>TCACCGCCAGCGGACAGTATGGACAGTGGGCCCCTAAACTGGCCAGACTGCACTACTCCGGCAGCATCAATGCCTGGTCCACCAAAGAGCCTTTCAGC<br>TGGATCAAAGTGGACCTGCTGGCTCCCATGATCATCCACGGAATCAAGACCCAGGGCGCCAGACAAAAGTTCAGCAGCCTGTACATCAGCCAGTTCAT<br>CATCATGTACAGCCTGGACGGAAAGAAGTGGCAGACCTACCGGGGCAATAGCACCGGCACACTGATGGTGTTCTTCGGCAACGTGGACTCCAGCGGCA<br>TTAAGCACAACATCTTCAACCCTCCAATCATTGCCCGGTACATCCGGCTGCACCCCACACACTACAGCATCAGGTCTACCCTGAGAATGGAACTGATG<br>GGCTGCGACCTGAACAGCTGCTCTATGCCCCTCGGAATGGAAAGCAAGGCCATCAGCGACGCCCAGATCACAGCCTCTAGCTACTTCACCAACATGTT<br>CGCCACTTGGAGCCCCTCTAAGGCCCGGCTTCATCTGCAAGGCAGAAGCAACGCTTGGAGGCCCCAAGTGAACAACCCCAAAGAATGGCTCCAGGTGG<br>ACTTTCAGAAAACCATGAAAGTGACAGGCGTGACCACACAGGGCGTCAAGTCCCTGCTGACCTCTATGTACGTGAAAGAGTTTCTGATCAGCTCCAGC<br>CAGGACGGCCACCAGTGGACCCTGTTCTTCCAGAACGGCAAAGTGAAAGTGTTCCAGGGAAATCAGGACAGCTTCACACCCGTGGTCAATAGTCTGGA<br>CCCACCACTGCTGACCCGCTACCTGCGAATTCACCCTCAGTCTTGGGTGCACCAGATTGCCCTGCGGATGGAAGTGCTGGGCTGTGAAGCTCAGGACC<br>TCTACTAGTTAATTAAGAGCATCTTACCGCCATTTATTCCCATATTTGTTCTGTTTTTCTTGATTTGGGTATACATTTAAATGTTAATAAAACAAAAT<br>GGTGGGGCAATCATTTACATTTTTAGGGATATGTAATTACTAGTTCAGGTGTATTGCCACAAGACAAACATGTTAAGAAACTTTCCCGTTATTTACGC<br>TCTGTTCCTGTTAATCAACCTCTGGATTACAAAATTTGTGAAAGATTGACTGATATTCTTAACTATGTTGCTCCTTTTACGCTGTGTGGATATGCTGC<br>TTTATAGCCTCTGTATCTAGCTATTGCTTCCCGTACGGCTTTCGTTTTCTCCTCCTTGTATAAATCCTGGTTGCTGTCTCTTTTAGAGGAGTTGTGGC<br>CCGTTGTCCGTCAACGTGGCGTGGTGTGCTCTGTGTTTGCTGACGCAACCCCCACTGGCTGGGGCATTGCCACCACCTGTCAACTCCTTTCTGGGACT<br>TTCGCTTTCCCCCTCCCGATCGCCACGGCAGAACTCATCGCCGCCTGCCTTGCCCGCTGCTGGACAGGGGCTAGGTTGCTGGGCACTGATAATTCCGT<br>GGTGTTGTCTGTGCCTTCTAGTTGCCAGCCATCTGTTGTTTGCCCCTCCCCCGTGCCTTCCTTGACCCTGGAAGGTGCCACTCCCACTGTCCTTTCCT |

TABLE 9-continued

| ceDNA Vector Name | Nucleic Acid Sequence |
|---|---|
| | AATAAAATGAGGAAATTGCATCGCATTGTCTGAGTAGGTGTCATTCTATTCTGGGGGGTGGGGTGGGGCAGGACAGCAAGGGGGAGGATTGGGAAGAC<br>AATAGCAGGCATGCTGGGGATGCGGTGGGCTCTATGGCTCTAGAGCATGGCTACGTAGATAAGTAGCATGGCGGGTTAATCATTAACTACACCTGCAG<br>GAGGAACCCCTAGTGATGGAGTTGGCCACTCCCTCTCTGCGCGCTCGCTCGCTCACTGAGGCCGGGCGACCAAAGGTCGCCCGACGCCCGGGCGGCCT<br>CAGTGAGCGAGCGAGCGCGCAGCTGCCTGCAGGGGCGCGCCTCGAGGCATGCGGTACCAAGCTTGTCGAGAAGTACTAGAGGATCATAATCAGCCATA<br>CCACATTTGTAGAGGTTTTACTTGCTTTAAAAAACCTCCCACACCTCCCCCTGAACCTGAAACATAAAATGAATGCAATTGTTGTTGTTAACTTGTTT<br>ATTGCAGCTTATAATGGTTACAAATAAAGCAATAGCATCACAAATTTCACAAATAAAGCATTTTTTTCACTGCATTCTAGTTGTGGTTTGTCCAAACT<br>CATCAATGTATCTTATCATGTCTGGATCTGATCACTGATATCGCCTAGGAGATCCGAACCAGATAAGTGAAATCTAGTTCCAAACTATTTTGTCATTT<br>TTAATTTTCGTATTAGCTTACGACGCTACACCCAGTTCCCATCTATTTTGTCACTCTTCCCTAAATAATCCTTAAAAACTCCATTTCCACCCCTCCCA<br>GTTCCCAACTATTTTGTCCGCCCACAGCGGGGCATTTTTCTTCCTGTTATGTTTTTAATCAAACATCCTGCCAACTCCATGTGACAAACCGTCATCTT<br>CGGCTACTTTTTCTCTGTCACAGAATGAAAATTTTTCTGTCATCTCTTCGTTATTAATGTTTGTAATTGACTGAATATCAACGCTTATTTGCAGCCTG<br>AATGGCGAATGG |
| ceDNAFVIII-vector 4 (SEQ ID NO: 195) | GACGCGCCCTGTAGCGGCGCATTAAGCGCGGCGGGTGTGGTGGTTACGCGCAGCGTGACCGCTACACTTGCCAGCGCCCTAGCGCCCGCTCCTTTCGC<br>TTTCTTCCCTTCCTTTCTCGCCACGTTCGCCGGCTTTCCCCGTCAAGCTCTAAATCGGGGGCTCCCTTTAGGGTTCCGATTTAGTGCTTTACGGCACC<br>TCGACCCCAAAAAACTTGATTAGGGTGATGGTTCACGTAGTGGGCCATCGCCCTGATAGACGGTTTTTCGCCCTTTGACGTTGGAGTCCACGTTCTTT<br>AATAGTGGACTCTTGTTCCAAACTGGAACAACACTCAACCCTATCTCGGTCTATTCTTTTGATTTATAAGGGATTTTGCCGATTTCGGCCTATTGGTT<br>AAAAAATGAGCTGATTTAACAAAAATTTAACGCGAATTTTAACAAAATATTAACGTTTACAATTTCAGGTGGCACTTTTCGGGGAAATGTGCGCGGAA<br>CCCCTATTTGTTTATTTTTCTAAATACATTCAAATATGTATCCGCTCATGAGACAATAACCCTGATAAATGCTTCAATAATATTGAAAAAGGAAGAGT<br>ATGAGTATTCAACATTTCCGTGTCGCCCTTATTCCCTTTTTTGCGGCATTTTGCCTTCCTGTTTTTGCTCACCCAGAAACGCTGGTGAAAGTAAAAGA<br>TGCTGAAGATCAGTTGGGTGCACGAGTGGGTTACATCGAACTGGATCTCAACAGCGGTAAGATCCTTGAGAGTTTTCGCCCCGAAGAACGTTTTCCAA<br>TGATGAGCACTTTTAAAGTTCTGCTATGTGGCGCGGTATTATCCCGTATTGACGCCGGGCAAGAGCAACTCGGTCGCCGCATACACTATTCTCAGAAT<br>GACTTGGTTGAGTACTCACCAGTCACAGAAAAGCATCTTACGGATGGCATGACAGTAAGAGAATTATGCAGTGCTGCCATAACCATGAGTGATAACAC<br>TGCGGCCAACTTACTTCTGACAACGATCGGAGGACCGAAGGAGCTAACCGCTTTTTTGCACAACATGGGGGATCATGTAACTCGCCTTGATCGTTGGG<br>AACCGGAGCTGAATGAAGCCATACCAAACGACGAGCGTGACACCACGATGCCTGTAGCAATGGCAACAACGTTGCGCAAACTATTAACTGGCGAACTA<br>CTTACTCTAGCTTCCCGGCAACAATTAATAGACTGGATGGAGGCGGATAAAGTTGCAGGACCACTTCTGCGCTCGGCCCTTCCGGCTGGCTGGTTTAT<br>TGCTGATAAATCTGGAGCCGGTGAGCGTGGGTCTCGCGGTATCATTGCAGCACTGGGGCCAGATGGTAAGCCCTCCCGTATCGTAGTTATCTACACGA<br>CGGGGAGTCAGGCAACTATGGATGAACGAAATAGACAGATCGCTGAGATAGGTGCCTCACTGATTAAGCATTGGTAACTGTCAGACCAAGTTTACTCA<br>TATATACTTTAGATTGATTTAAAACTTCATTTTTAATTTAAAAGGATCTAGGTGAAGATCCTTTTTGATAATCTCATGACCAAAATCCCTTAACGTGA<br>GTTTTCGTTCCACTGAGCGTCAGACCCCGTAGAAAAGATCAAAGGATCTTCTTGAGATCCTTTTTTTCTGCGCGTAATCTGCTGCTTGCAAACAAAAA<br>AACCACCGCTACCAGCGGTGGTTTGTTTGCCGGATCAAGAGCTACCAACTCTTTTTCCGAAGGTAACTGGCTTCAGCAGAGCGCAGATACCAAATACT<br>GTCCTTCTAGTGTAGCCGTAGTTAGGCCACCACTTCAAGAACTCTGTAGCACCGCCTACATACCTCGCTCTGCTAATCCTGTTACCAGTGGCTGCTGC<br>CAGTGGCGATAAGTCGTGTCTTACCGGGTTGGACTCAAGACGATAGTTACCGGATAAGGCGCAGCGGTCGGGCTGAACGGGGGGTTCGTGCACACAGC<br>CCAGCTTGGAGCGAACGACCTACACCGAACTGAGATACCTACAGCGTGAGCATTGAGAAAGCGCCACGCTTCCCGAAGGGAGAAAGGCGGACAGGTAT<br>CCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTG<br>ACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGC<br>CTTTTGCTCACATGTTCTTTCCTGCGTTATCCCCTGATTCTGTGGATAACCGTATTACCGCCTTTGAGTGAGCTGATACCGCTCGCCGCAGCCGAACG<br>ACCGAGCGCAGCGAGTCAGTGAGCGAGGAAGCGGAAGAGCGCCTGATGCGGTATTTTCTCCTTACGCATCTGTGCGGTATTTCACACCGCAGACCAGC<br>CGCGTAACCTGGCAAAATCGGTTACGGTTGAGTAATAAATGGATGCCCTGCGTAAGCGGGTGTGGGCGGACAATAAAGTCTTAAACTGAACAAAATAG<br>ATCTAAACTATGACAATAAAGTCTTAAACTAGACAGAATAGTTGTAAACTGAAATCAGTCCAGTTATGCTGTGAAAAAGCATACTGGACTTTTGTTAT<br>GGCTAAAGCAAACTCTTCATTTTCTGAAGTGCAAATTGCCCGTCGTATTAAAGAGGGGCGTGGCCAAGGGCATGGTAAAGACTATATTCGCGGCGTTG<br>TGACAATTTACCGAACAACTCCGCGGCCGGGAAGCCGATCTCGGCTTGAACGAATTGTTAGGTGGCGGTACTTGGGTCGATATCAAAGTGCATCACTT<br>CTTCCCGTATGCCCAACTTTGTATAGAGAGCCACTGCGGGATCGTCACCGTAATCTGCTTGCACGTAGATCACATAAGCACCAAGCGCGTTGGCCTCA<br>TGCTTGAGGAGATTGATGAGCGCGGTGGCAATGCCCTGCCTCCGGTGCTCGCCGGAGACTGCGAGATCATAGATATAGATCTCACTACGCGGCTGCTC<br>AAACCTGGGCAGAACGTAAGCCGCGAGAGCGCCAACAACCGCTTCTTGGTCGAAGGCAGCAAGCGCGATGAATGTCTTACTACGGAGCAAGTTCCCGA<br>GGTAATCGGAGTCCGGCTGATGTTGGGAGTAGGTGGCTACGTCTCCGAACTCACGACCGAAAAGATCAAGAGCAGCCCGCATGGATTTGACTTGGTCA<br>GGGCCGAGCCTACATGTGCGAATGATGCCCATACTTGAGCCACCTAACTTTGTTTTAGGGCGACTGCCCTGCTGCGTAACATCGTTGCTGCTGCGTAA<br>CATCGTTGCTGCTCCATAACATCAAACATCGACCCACGGCGTAACGCGCTTGCTGCTTGGATGCCCGAGGCATAGACTGTACAAAAAAACAGTCATAA<br>CAAGCCATGAAAACCGCCACTGCGCCGTTACCACCGCTGCGTTCGGTCAAGGTTCTGGACCAGTTGCGTGAGCGCATACGCTACTTGCATTACAGTTT<br>ACGAACCGAACAGGCTTATGTCAACTGGGTTCGTGCCTTCATCCGTTTCCACGGTGTGCGTCACCCGGCAACCTTGGGCAGCAGCGAAGTCGAGGCAT<br>TTCTGTCCTGGCTGGCGAACGAGCGCAAGGTTTCGGTCTCCACGCATCGTCAGGCATTGGCGGCCTTGCTGTTCTTCTACGGCAAGGTGCTGTGCACG |

TABLE 9-continued

| ceDNA Vector Name | Nucleic Acid Sequence |
|---|---|
| | GATCTGCCCTGGCTTCAGGAGATCGGAAGACCTCGGCCGTCGCGGCGCTTGCCGGTGGTGCTGACCCCGGATGAAGTGGTTCGCATCCTCGGTTTTCT |
| | GGAAGGCGAGCATCGTTTGTTCGCCCAGGACTCTAGCTATAGTTCTAGTGGTTGGCTACGTATACTCCGGAATATTAATAGATCATGGAGATAATTAA |
| | AATGATAACCATCTCGCAAATAAATAAGTATTTTACTGTTTTCGTAACAGTTTTGTAATAAAAAAACCTATAAATATTCCGGATTATTCATACCGTCC |
| | CACCATCGGGCGCGGATCTCGGTCCGAAACCATGTCGTACTACCATCACCATCACCATCACGATTACGATATCCCAACGACCGAAAACCTGTATTTTC |
| | AGGGCGCCATGGGATCCGGCCGGCCCCTGCAGGCAGCTGCGCGCTCGCTCGCTCACTGAGGCCGCCCGGGCAAAGCCCGGGCGTCGGGCGACCTTTGG |
| | TCGCCCGGCCTCAGTGAGCGAGCGAGCGCGCAGAGAGGGAGTGGCCAACTCCATCACTAGGGGTTCCTTGTAGTTAATGATTAACCCGCCATGCTACT |
| | TATCTACGTAGCCATGCTCTAGAGCGGCCGCCCCTAAAATGGGCAAACATTGCAAGCAGCAAACAGCAAACACACAGCCCTCCCTGCCTGCTGACCTT |
| | GGAGCTGGGGCAGAGGTCAGAGACCTCTCTGGGCCCATGCCACCTCCAACATCCACTCGACCCCTTGGAATTTTTCGGTGGAGAGGAGCAGAGGTTGT |
| | CCTGGCGTGGTTTAGGTAGTGTGAGAGGG**GAATGACTCCTTTCGGTAAGTGCAGTGGAAGCTGTACACTGCCCAGGCAAAGCGTCCGGGCAGCGTAGG** |
| | **CGGGCGACTCAGATCCCAGCCAGTGGACTTAGCCCCTGTTTGCTCCTCCGATAACTGGGGTGACCTTGGTTAATATTCACCAGCAGCCTCCCCCGTTG** |
| | **CCCCTCTGGATCCACTGCTTAAATACGGACGAGGACAGG**GCCCTGTCTCCTCAGCTTCAGGCACCACCACTGACCTGGGACAGTGAATCCGGACTCTA |
| | AGGTAAATATAAAATTTTTAAGTGTATAATGTGTTAAACTACTGATTCTAATTGTTTCTCTCTTTTAGATTCCAACCTTTGGAACTGAGTTTAAACCG |
| | CAGCCACCATGCAGATCGAGCTGTCTACCTGCTTCTTCCTGTGCCTGCTGCGGTTCTGCTTCAGCGCCACCAGAAGATATTACCTGGGCGCCGTGGAA |
| | CTGAGCTGGGACTACATGCAGTCTGACCTGGGAGAGCTGCCCGTGGACGCTAGATTTCCTCCAAGAGTGCCCAAGAGCTTCCCCTTCAACACCTCCGT |
| | GGTGTACAAGAAAACCCTGTTCGTGGAATTCACCGACCACCTGTTCAATATCGCCAAGCCTCGGCCTCCTTGGATGGGACTGCTGGGACCTACAATTC |
| | AGGCCGAGGTGTACGACACCGTGGTCATCACCCTGAAGAACATGGCCAGCCATCCTGTGTCTCTGCACGCCGTGGGAGTGTCTTATTGGAAGGCTTCT |
| | GAGGGCGCCGAGTACGACGATCAGACAAGCCAGAGAGAGAAAGAGGACGACAAGGTTTTCCCTGGCGGCAGCCACACCTATGTCTGGCAGGTCCTGAA |
| | AGAAAACGGCCCTATGGCCTCCGATCCTCTGTGCCTGACATACAGCTACCTGAGCCACGTGGACCTGGTCAAGGACCTGAATTCTGGCCTGATCGGAG |
| | CCCTGCTCGTGTGTAGAGAAGGCAGCCTGGCCAAAGAGAAAACCCAGACACTGCACAAGTTCATCCTGCTGTTCGCCGTGTTCGACGAGGGCAAGAGC |
| | TGGCACAGCGAGACAAAGAACAGCCTGATGCAGGACAGGGATGCCGCCTCTGCTAGAGCTTGGCCTAAGATGCACACCGTGAACGGCTACGTGAACAG |
| | AAGCCTGCCTGGACTGATCGGCTGCCACAGAAAGTCCGTGTACTGGCACGTGATCGGCATGGGCACAACACCTGAGGTGCACAGCATCTTTCTGGAAG |
| | GCCACACCTTCCTCGTGCGGAACCACAGACAGGCCAGCCTGGAAATCAGCCCTATCACCTTCCTGACCGCTCAGACCCTGCTGATGGATCTGGGCCAG |
| | TTTCTGCTGTTCTGCCACATCAGCTCCCACCAGCACGATGGCATGGAAGCCTACGTGAAGGTGGACAGCTGCCCCGAAGAACCCCAGCTGCGGATGAA |
| | GAACAACGAGGAAGCCGAGGACTACGACGACGACCTGACCGACTCTGAGATGGACGTCGTCAGATTCGACGACGATAACAGCCCCAGCTTCATCCAGA |
| | TCAGAAGCGTGGCCAAGAAGCACCCCAAGACCTGGGTGCACTATATCGCCGCCGAGGAAGAGGACTGGGATTACGCTCCTCTGGTGCTGGCCCCTGAC |
| | GACAGAAGCTACAAGAGCCAGTACCTGAACAACGGCCCTCAGCGGATCGGCCGGAAGTATAAGAAAGTGCGGTTCATGGCCTACACCGACGAGACATT |
| | CAAGACCAGAGAGGCCATCCAGCACGAGAGCGGAATTCTGGGCCCTCTGCTGTATGGCGAAGTGGGCGATACACTGCTGATCATCTTCAAGAACCAGG |
| | CCAGCAGACCCTACAACATCTACCCTCACGGCATCACCGATGTGCGGCCCCTGTATTCTAGAAGGCTGCCCAAGGGCGTGAAGCACCTGAAGGACTTC |
| | CCTATCCTGCCTGGCGAGATTTTCAAGTACAAGTGGACCGTGACCGTGGAAGATGGCCCCACCAAGAGCGACCCTAGATGTCTGACACGGTACTACAG |
| | CAGCTTCGTGAACATGGAACGCGACCTGGCCAGCGGCCTGATTGGACCTCTGCTGATCTGCTACAAAGAAAGCGTGGACCAGCGGGGCAACCAGATCA |
| | TGAGCGACAAGCGGAACGTGATCCTGTTTAGCGTGTTCGATGAGAACCGGTCCTGGTATCTGACCGAGAACATCCAGCGGTTTCTGCCCAATCCTGCC |
| | GGGGTGCAACTGGAAGATCCTGAGTTCCAGGCAAGCAACATCATGCACTCCATCAATGGCTATGTGTTCGACAGCCTGCAGCTGAGCGTGTGCCTGCA |
| | CGAAGTGGCCTACTGGTACATCCTGAGCATTGGCGCCCAGACCGACTTCCTGTCCGTGTTCTTTAGCGGCTACACCTTCAAGCACAAGATGGTGTACG |
| | AGGATACCCTGACACTGTTCCCATTCAGCGGCGAGACAGTGTTCATGAGCATGGAAAACCCCGGCCTGTGGATTCTGGGCTGTCACAACAGCGACTTC |
| | CGGAACAGAGGCATGACAGCCCTGCTGAAGGTGTCCAGCTGCGACAAGAACACCGGCGACTACTACGAGGACAGCTATGAGGACATCAGCGCCTACCT |
| | GCTGAGCAAGAACAATGCCATCGAGCCTCGGAGCTTCAGCCAGAATCCTCCTGTGCTGAAGCGGCACCAGCGCGAGATCACCAGAACAACCCTGCAGA |
| | GCGACCAAGAGGAAATCGATTACGACGACACCATCAGCGTCGAGATGAAGAAAGAAGATTTCGACATCTACGACGAGGACGAGAATCAGAGCCCCAGA |
| | AGCTTTCAGAAAAAGACCCGGCACTACTTCATTGCCGCCGTCGAGAGACTGTGGGACTACGGCATGTCTAGCAGCCCTCACGTGCTGAGAAATAGAGC |
| | CCAGAGCGGCAGCGTGCCCCAGTTCAAGAAAGTGGTGTTCCAAGAGTTCACCGACGGCAGCTTCACCCAGCCACTGTATAGAGGCGAGCTGAACGAGC |
| | ATCTGGGCCTGCTGGGCCCTTATATCAGAGCCGAAGTGGAAGATAACATCATGGTCACCTTCCGGAATCAGGCTAGCCGGCCTTACAGCTTCTACAGC |
| | TCCCTGATCAGCTACGAAGAGGACCAGAGACAGGGCGCTGAGCCCAGAAAGAACTTCGTGAAGCCCAACGAGACTAAGACCTACTTTTGGAAGGTGCA |
| | GCACCACATGGCCCCTACAAAGGACGAGTTCGACTGCAAAGCCTGGGCCTACTTCTCCGATGTGGATCTGGAAAAGGACGTGCACAGCGGGCTCATCG |
| | GACCACTGCTTGTGTGCCACACCAACACACTGAACCCCGCTCACGGCAGACAAGTGACAGTGCAAGAGTTCGCCCTGTTCTTCACCATCTTCGACGAA |
| | ACAAAGAGCTGGTACTTCACCGAGAATATGGAACGGAACTGCAGAGCCCCTTGCAACATCCAGATGGAAGATCCCACCTTCAAAGAGAACTACCGGTT |
| | CCACGCCATCAACGGCTACATCATGGACACACTGCCCGGCCTGGTTATGGCCCAGGATCAGAGAATCCGGTGGTATCTGCTGTCCATGGGCTCCAACG |
| | AGAATATCCACAGCATCCACTTCAGCGGCCACGTGTTCACCGTGCGGAAAAAAGAAGAGTACAAAATGGCCCTGTACAATCTGTACCCTGGGGTGTTC |
| | GAAACCGTGGAAATGCTGCCTTCCAAGGCCGGCATTTGGAGAGTGGAATGTCTGATTGGAGAGCACCTCCACGCCGGAATGAGCACCCTGTTTCTGGT |
| | GTACAGCAACAAGTGTCAGACCCCTCTCGGCATGGCCTCTGGACACATCAGAGACTTCCAGATCACCGCCTCTGGCCAGTACGGACAGTGGGCTCCTA |
| | AACTGGCTCGGCTGCACTACAGCGGCAGCATCAATGCCTGGTCCACCAAAGAGCCCTTCAGCTGGATCAAGGTGGACCTGCTGGCTCCCATGATCATC |
| | CACGGAATCAAGACCCAGGGCGCCAGACAGAAGTTCAGCAGCCTGTACATCAGCCAGTTCATCATCATGTACAGCCTGGACGGCAAGAAGTGGCAGAC |

TABLE 9-continued

| ceDNA Vector Name | Nucleic Acid Sequence |
|---|---|
| | CTACAGAGGCAACAGCACCGGCACACTCATGGTGTTCTTCGGCAACGTGGACTCCAGCGGCATTAAGCACAACATCTTCAACCCTCCAATCATTGCCC<br>GGTACATCCGGCTGCACCCCACACACTACAGCATCCGGTCTACCCTGAGAATGGAACTGATGGGCTGCGACCTGAACAGCTGCTCTATGCCCCTCGGA<br>ATGGAAAGCAAGGCCATCAGCGACGCCCAGATCACAGCCAGCAGCTACTTCACCAACATGTTCGCCACTTGGAGCCCCTCCAAGGCTAGACTGCATCT<br>GCAGGGCAGAAGCAACGCTTGGAGGCCCCAAGTGAACAACCCCAAAGAGTGGCTGCAGGTTGACTTTCAAAAGACCATGAAAGTGACCGGCGTGACCA<br>CACAGGGCGTCAAGTCTCTGCTGACCTCTATGTACGTGAAAGAGTTCCTGATCTCCAGCAGCCAGGACGGCCATCAGTGGACCCTGTTTTTCCAGAAC<br>GGCAAAGTGAAAGTGTTCCAGGGCAATCAGGACAGCTTCACACCCGTGGTCAATTCTCTGGACCCTCCACTGCTGACCAGATACCTGCGGATTCACCC<br>TCAGTCTTGGGTGCACCAGATCGCTCTGCGGATGGAAGTGCTGGGCTGTGAAGCTCAGGACCTCTACTAGTTAATTAAGAGCATCTTACCGCCATTTA<br>TTCCCATATTTGTTCTGTTTTTCTTGATTTGGGTATACATTTAAATGTTAATAAAACAAAATGGTGGGGCAATCATTTACATTTTTAGGGATATGTAA<br>TTACTAGTTCAGGTGTATTGCCACAAGACAAACATGTTAAGAAACTTTCCCGTTATTTACGCTCTGTTCCTGTTAATCAACCTCTGGATTACAAAATT<br>TGTGAAAGATTGACTGATATTCTTAACTATGTTGCTCCTTTTACGCTGTGTGGATATGCTGCTTTATAGCCTCTGTATCTAGCTATTGCTTCCCGTAC<br>GGCTTTCGTTTTCTCCTCCTTGTATAAATCCTGGTTGCTGTCTCTTTTAGAGGAGTTGTGGCCCGTTGTCCGTCAACGTGGCGTGGTGTGCTCTGTGT<br>TTGCTGACGCAACCCCCACTGGCTGGGGCATTGCCACCACCTGTCAACTCCTTTCTGGGACTTTCGCTTTCCCCCTCCCGATCGCCACGGCAGAACTC<br>ATCGCCGCCTGCCTTGCCCGCTGCTGGACAGGGGCTAGGTTGCTGGGCACTGATAATTCCGTGGTGTTGTCTGTGCCTTCTAGTTGCCAGCCATCTGT<br>TGTTTGCCCCTCCCCCGTGCCTTCCTTGACCCTGGAAGGTGCCACTCCCACTGTCCTTTCCTAATAAAATGAGGAAATTGCATCGCATTGTCTGAGTA<br>GGTGTCATTCTATTCTGGGGGGTGGGGTGGGGCAGGACAGCAAGGGGGAGGATTGGGAAGACAATAGCAGGCATGCTGGGGATGCGGTGGGCTCTATG<br>GCTCTAGAGCATGGCTACGTAGATAAGTAGCATGGCGGGTTAATCATTAACTACACCTGCAGGAGGAACCCCTAGTGATGGAGTTGGCCACTCCCTCT<br>CTGCGCGCTCGCTCGCTCACTGAGGCCGGGCGACCAAAGGTCGCCCGACGCCCGGGCGGCCTCAGTGAGCGAGCGAGCGCGCAGCTGCCTGCAGGGGC<br>GCGCCTCGAGGCATGCGGTACCAAGCTTGTCGAGAAGTACTAGAGGATCATAATCAGCCATACCACATTTGTAGAGGTTTTACTTGCTTTAAAAAACC<br>TCCCACACCTCCCCCTGAACCTGAAACATAAAATGAATGCAATTGTTGTTGTTAACTTGTTTATTGCAGCTTATAATGGTTACAAATAAAGCAATAGC<br>ATCACAAATTTCACAAATAAAGCATTTTTTTCACTGCATTCTAGTTGTGGTTTGTCCAAACTCATCAATGTATCTTATCATGTCTGGATCTGATCACT<br>GATATCGCCTAGGAGATCCGAACCAGATAAGTGAAATCTAGTTCCAAACTATTTTGTCATTTTTAATTTTCGTATTAGCTTACGACGCTACACCCAGT<br>TCCCATCTATTTTGTCACTCTTCCCTAAATAATCCTTAAAAACTCCATTTCCACCCCTCCCAGTTCCCAACTATTTTGTCCGCCCACAGCGGGGCATT<br>TTTCTTCCTGTTATGTTTTTAATCAAACATCCTGCCAACTCCATGTGACAAACCGTCATCTTCGGCTACTTTTTCTCTGTCACAGAATGAAAATTTTT<br>CTGTCATCTCTTCGTTATTAATGTTTGTAATTGACTGAATATCAACGCTTATTTGCAGCCTGAATGGCGAATGG |
| ceDNAFVIII-vector 5 (SEQ ID NO: 196) | GACGCGCCCTGTAGCGGCGCATTAAGCGCGGCGGGTGTGGTGGTTACGCGCAGCGTGACCGCTACACTTGCCAGCGCCCTAGCGCCCGCTCCTTTCGC<br>TTTCTTCCCTTCCTTTCTCGCCACGTTCGCCGGCTTTCCCCGTCAAGCTCTAAATCGGGGGCTCCCTTTAGGGTTCCGATTTAGTGCTTTACGGCACC<br>TCGACCCCAAAAAACTTGATTAGGGTGATGGTTCACGTAGTGGGCCATCGCCCTGATAGACGGTTTTTCGCCCTTTGACGTTGGAGTCCACGTTCTTT<br>AATAGTGGACTCTTGTTCCAAACTGGAACAACACTCAACCCTATCTCGGTCTATTCTTTTGATTTATAAGGGATTTTGCCGATTTCGGCCTATTGGTT<br>AAAAAATGAGCTGATTTAACAAAAATTTAACGCGAATTTTAACAAAATATTAACGTTTACAATTTCAGGTGGCACTTTTCGGGGAAATGTGCGCGGAA<br>CCCCTATTTGTTTATTTTTCTAAATACATTCAAATATGTATCCGCTCATGAGACAATAACCCTGATAAATGCTTCAATAATATTGAAAAAGGAAGAGT<br>ATGAGTATTCAACATTTCCGTGTCGCCCTTATTCCCTTTTTTGCGGCATTTTGCCTTCCTGTTTTTGCTCACCCAGAAACGCTGGTGAAAGTAAAAGA<br>TGCTGAAGATCAGTTGGGTGCACGAGTGGGTTACATCGAACTGGATCTCAACAGCGGTAAGATCCTTGAGAGTTTTCGCCCCGAAGAACGTTTTCCAA<br>TGATGAGCACTTTTAAAGTTCTGCTATGTGGCGCGGTATTATCCCGTATTGACGCCGGGCAAGAGCAACTCGGTCGCCGCATACACTATTCTCAGAAT<br>GACTTGGTTGAGTACTCACCAGTCACAGAAAAGCATCTTACGGATGGCATGACAGTAAGAGAATTATGCAGTGCTGCCATAACCATGAGTGATAACAC<br>TGCGGCCAACTTACTTCTGACAACGATCGGAGGACCGAAGGAGCTAACCGCTTTTTTGCACAACATGGGGGATCATGTAACTCGCCTTGATCGTTGGG<br>AACCGGAGCTGAATGAAGCCATACCAAACGACGAGCGTGACACCACGATGCCTGTAGCAATGGCAACAACGTTGCGCAAACTATTAACTGGCGAACTA<br>CTTACTCTAGCTTCCCGGCAACAATTAATAGACTGGATGGAGGCGGATAAAGTTGCAGGACCACTTCTGCGCTCGGCCCTTCCGGCTGGCTGGTTTAT<br>TGCTGATAAATCTGGAGCCGGTGAGCGTGGGTCTCGCGGTATCATTGCAGCACTGGGGCCAGATGGTAAGCCCTCCCGTATCGTAGTTATCTACACGA<br>CGGGGAGTCAGGCAACTATGGATGAACGAAATAGACAGATCGCTGAGATAGGTGCCTCACTGATTAAGCATTGGTAACTGTCAGACCAAGTTTACTCA<br>TATATACTTTAGATTGATTTAAAACTTCATTTTTAATTTAAAAGGATCTAGGTGAAGATCCTTTTTGATAATCTCATGACCAAAATCCCTTAACGTGA<br>GTTTTCGTTCCACTGAGCGTCAGACCCCGTAGAAAAGATCAAAGGATCTTCTTGAGATCCTTTTTTTCTGCGCGTAATCTGCTGCTTGCAAACAAAAA<br>AACCACCGCTACCAGCGGTGGTTTGTTTGCCGGATCAAGAGCTACCAACTCTTTTTCCGAAGGTAACTGGCTTCAGCAGAGCGCAGATACCAAATACT<br>GTCCTTCTAGTGTAGCCGTAGTTAGGCCACCACTTCAAGAACTCTGTAGCACCGCCTACATACCTCGCTCTGCTAATCCTGTTACCAGTGGCTGCTGC<br>CAGTGGCGATAAGTCGTGTCTTACCGGGTTGGACTCAAGACGATAGTTACCGGATAAGGCGCAGCGGTCGGGCTGAACGGGGGGTTCGTGCACACAGC<br>CCAGCTTGGAGCGAACGACCTACACCGAACTGAGATACCTACAGCGTGAGCATTGAGAAAGCGCCACGCTTCCCGAAGGGAGAAAGGCGGACAGGTAT<br>CCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTG<br>ACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGC<br>CTTTTGCTCACATGTTCTTTCCTGCGTTATCCCCTGATTCTGTGGATAACCGTATTACCGCCTTTGAGTGAGCTGATACCGCTCGCCGCAGCCGAACG<br>ACCGAGCGCAGCGAGTCAGTGAGCGAGGAAGCGGAAGAGCGCCTGATGCGGTATTTTCTCCTTACGCATCTGTGCGGTATTTCACACCGCAGACCAGC |

TABLE 9-continued

| ceDNA Vector Name | Nucleic Acid Sequence |
|---|---|
| | CGCGTAACCTGGCAAAATCGGTTACGGTTGAGTAATAAATGGATGCCCTGCGTAAGCGGGTGTGGGCGGACAATAAAGTCTTAAACTGAACAAAATAG |
| | ATCTAAACTATGACAATAAAGTCTTAAACTAGACAGAATAGTTGTAAACTGAAATCAGTCCAGTTATGCTGTGAAAAAGCATACTGGACTTTTGTTAT |
| | GGCTAAAGCAAACTCTTCATTTTCTGAAGTGCAAATTGCCCGTCGTATTAAAGAGGGGCGTGGCCAAGGGCATGGTAAAGACTATATTCGCGGCGTTG |
| | TGACAATTTACCGAACAACTCCGCGGCCGGGAAGCCGATCTCGGCTTGAACGAATTGTTAGGTGGCGGTACTTGGGTCGATATCAAAGTGCATCACTT |
| | CTTCCCGTATGCCCAACTTTGTATAGAGAGCCACTGCGGGATCGTCACCGTAATCTGCTTGCACGTAGATCACATAAGCACCAAGCGCGTTGGCCTCA |
| | TGCTTGAGGAGATTGATGAGCGCGGTGGCAATGCCCTGCCTCCGGTGCTCGCCGGAGACTGCGAGATCATAGATATAGATCTCACTACGCGGCTGCTC |
| | AAACCTGGGCAGAACGTAAGCCGCGAGAGCGCCAACAACCGCTTCTTGGTCGAAGGCAGCAAGCGCGATGAATGTCTTACTACGGAGCAAGTTCCCGA |
| | GGTAATCGGAGTCCGGCTGATGTTGGGAGTAGGTGGCTACGTCTCCGAACTCACGACCGAAAAGATCAAGAGCAGCCCGCATGGATTTGACTTGGTCA |
| | GGGCCGAGCCTACATGTGCGAATGATGCCCATACTTGAGCCACCTAACTTTGTTTTAGGGCGACTGCCCTGCTGCGTAACATCGTTGCTGCTGCGTAA |
| | CATCGTTGCTGCTCCATAACATCAAACATCGACCCACGGCGTAACGCGCTTGCTGCTTGGATGCCCGAGGCATAGACTGTACAAAAAAACAGTCATAA |
| | CAAGCCATGAAAACCGCCACTGCGCCGTTACCACCGCTGCGTTCGGTCAAGGTTCTGGACCAGTTGCGTGAGCGCATACGCTACTTGCATTACAGTTT |
| | ACGAACCGAACAGGCTTATGTCAACTGGGTTCGTGCCTTCATCCGTTTCCACGGTGTGCGTCACCCGGCAACCTTGGGCAGCAGCGAAGTCGAGGCAT |
| | TTCTGTCCTGGCTGGCGAACGAGCGCAAGGTTTCGGTCTCCACGCATCGTCAGGCATTGGCGGCCTTGCTGTTCTTCTACGGCAAGGTGCTGTGCACG |
| | GATCTGCCCTGGCTTCAGGAGATCGGAAGACCTCGGCCGTCGCGGCGCTTGCCGGTGGTGCTGACCCCGGATGAAGTGGTTCGCATCCTCGGTTTTCT |
| | GGAAGGCGAGCATCGTTTGTTCGCCCAGGACTCTAGCTATAGTTCTAGTGGTTGGCTACGTATACTCCGGAATATTAATAGATCATGGAGATAATTAA |
| | AATGATAACCATCTCGCAAATAAATAAGTATTTTACTGTTTTCGTAACAGTTTTGTAATAAAAAAACCTATAAATATTCCGGATTATTCATACCGTCC |
| | CACCATCGGGCGCGGATCTCGGTCCGAAACCATGTCGTACTACCATCACCATCACCATCACGATTACGATATCCCAACGACCGAAAACCTGTATTTTC |
| | AGGGCGCCATGGGATCCGGCCGGCCCCTGCAGGCAGCTGCGCGCTCGCTCGCTCACTGAGGCCGCCCGGGCAAAGCCCGGGCGTCGGGCGACCTTTGG |
| | TCGCCCGGCCTCAGTGAGCGAGCGAGCGCGCAGAGAGGGAGTGGCCAACTCCATCACTAGGGGTTCCTTGTAGTTAATGATTAACCCGCCATGCTACT |
| | TATCTACGTAGCCATGCTCTAGAGCGGCCGC**GGCTCCGGTGCCCGTCAGTGGGCAGAGCGCACATCGCCCACAGTCCCCGAGAAGTTGGGGGGAGGGG** |
| | **TCGGCAATTGAACCGGTGCCTAGAGAAGGTGGCGCGGGGTAAACTGGGAAAGTGATGTCGTGTACTGGCTCCGCCTTTTTCCCGAGGGTGGGGGAGAA** |
| | **CCGTATATAAGTGCAGTAGTCGCCGTGAACGTTCTTTTTCGCAACGGGTTTGCCGCCAGAACACAGGTAAGTGCCGTGTGTGGTTCCCGC**GGGCCTGG |
| | CCTCTTTACGGGTTATGGCCCTTGCGTGCCTTGAATTACTTCCACCTGGCTGCAGTACGTGATTCTTGATCCCGAGCTTCGGGTTGGAAGTGGGTGGG |
| | AGAGTTCGAGGCCTTGCGCTTAAGGAGCCCCTTCGCCTCGTGCTTGAGTTGAGGCCTGGCCTGGGCGCTGGGGCCGCCGCGTGCGAATCTGGTGGCAC |
| | CTTCGCGCCTGTCTCGCTGCTTTCGATAAGTCTCTAGCCATTTAAAATTTTTGATGACCTGCTGCGACGCTTTTTTTCTGGCAAGATAGTCTTGTAAA |
| | TGCGGGCCAAGATCTGCACACTGGTATTTCGGTTTTTGGGGCCGCGGGCGGCGACGGGGCCCGTGCGTCCCAGCGCACATGTTCGGCGAGGCGGGGCC |
| | TGCGAGCGCGGCCACCGAGAATCGGACGGGGGTAGTCTCAAGCTGGCCGGCCTGCTCTGGTGCCTGGTCTCGCGCCGCCGTGTATCGCCCCGCCCTGG |
| | GCGGCAAGGCTGGCCCGGTCGGCACCAGTTGCGTGAGCGGAAAGATGGCCGCTTCCCGGCCCTGCTGCAGGGAGCTCAAAATGGAGGACGCGGCGCTC |
| | GGGAGAGCGGGCGGGTGAGTCACCCACACAAAGGAAAAGGGCCTTTCCGTCCTCAGCCGTCGCTTCATGTGACTCCACGGAGTACCGGGCGCCGTCCA |
| | GGCACCTCGATTAGTTCTCGAGCTTTTGGAGTACGTCGTCTTTAGGTTGGGGGGAGGGGTTTTATGCGATGGAGTTTCCCCACACTGAGTGGGTGGAG |
| | ACTGAAGTTAGGCCAGCTTGGCACTTGATGTAATTCTCCTTGGAATTTGCCCTTTTTGAGTTTGGATCTTGGTTCATTCTCAAGCCTCAGACAGTGGT |
| | TCAAAGTTTTTTTCTTCCATTTCAGGTGTCGTGAGTTTAAACCGCAGCCACCATGCAGATCGAGCTGTCTACCTGCTTCTTCCTGTGCCTGCTGCGGT |
| | TCTGCTTCAGCGCCACCAGAAGATATTACCTGGGCGCCGTGGAACTGAGCTGGGACTACATGCAGTCTGACCTGGGAGAGCTGCCCGTGGACGCTAGA |
| | TTTCCTCCAAGAGTGCCCAAGAGCTTCCCCTTCAACACCTCCGTGGTGTACAAGAAAACCCTGTTCGTGGAATTCACCGACCACCTGTTCAATATCGC |
| | CAAGCCTCGGCCTCCTTGGATGGGACTGCTGGGACCTACAATTCAGGCCGAGGTGTACGACACCGTGGTCATCACCCTGAAGAACATGGCCAGCCATC |
| | CTGTGTCTCTGCACGCCGTGGGAGTGTCTTATTGGAAGGCTTCTGAGGGCGCCGAGTACGACGATCAGACAAGCCAGAGAGAGAAAGAGGACGACAAG |
| | GTTTTCCCTGGCGGCAGCCACACCTATGTCTGGCAGGTCCTGAAAGAAAACGGCCCTATGGCCTCCGATCCTCTGTGCCTGACATACAGCTACCTGAG |
| | CCACGTGGACCTGGTCAAGGACCTGAATTCTGGCCTGATCGGAGCCCTGCTCGTGTGTAGAGAAGGCAGCCTGGCCAAAGAGAAAACCCAGACACTGC |
| | ACAAGTTCATCCTGCTGTTCGCCGTGTTCGACGAGGGCAAGAGCTGGCACAGCGAGACAAAGAACAGCCTGATGCAGGACAGGGATGCCGCCTCTGCT |
| | AGAGCTTGGCCTAAGATGCACACCGTGAACGGCTACGTGAACAGAAGCCTGCCTGGACTGATCGGCTGCCACAGAAAGTCCGTGTACTGGCACGTGAT |
| | CGGCATGGGCACAACACCTGAGGTGCACAGCATCTTTCTGGAAGGCCACACCTTCCTCGTGCGGAACCACAGACAGGCCAGCCTGGAAATCAGCCCTA |
| | TCACCTTCCTGACCGCTCAGACCCTGCTGATGGATCTGGGCCAGTTTCTGCTGTTCTGCCACATCAGCTCCCACCAGCACGATGGCATGGAAGCCTAC |
| | GTGAAGGTGGACAGCTGCCCCGAAGAACCCCAGCTGCGGATGAAGAACAACGAGGAAGCCGAGGACTACGACGACGACCTGACCGACTCTGAGATGGA |
| | CGTCGTCAGATTCGACGACGATAACAGCCCCAGCTTCATCCAGATCAGAAGCGTGGCCAAGAAGCACCCCAAGACCTGGGTGCACTATATCGCCGCCG |
| | AGGAAGAGGACTGGGATTACGCTCCTCTGGTGCTGGCCCCTGACGACAGAAGCTACAAGAGCCAGTACCTGAACAACGGCCCTCAGCGGATCGGCCGG |
| | AAGTATAAGAAAGTGCGGTTCATGGCCTACACCGACGAGACATTCAAGACCAGAGAGGCCATCCAGCACGAGAGCGGAATTCTGGGCCCTCTGCTGTA |
| | TGGCGAAGTGGGCGATACACTGCTGATCATCTTCAAGAACCAGGCCAGCAGACCCTACAACATCTACCCTCACGGCATCACCGATGTGCGGCCCCTGT |
| | ATTCTAGAAGGCTGCCCAAGGGCGTGAAGCACCTGAAGGACTTCCCTATCCTGCCTGGCGAGATTTTCAAGTACAAGTGGACCGTGACCGTGGAAGAT |
| | GGCCCCACCAAGAGCGACCCTAGATGTCTGACACGGTACTACAGCAGCTTCGTGAACATGGAACGCGACCTGGCCAGCGGCCTGATTGGACCTCTGCT |
| | GATCTGCTACAAAGAAAGCGTGGACCAGCGGGGCAACCAGATCATGAGCGACAAGCGGAACGTGATCCTGTTTAGCGTGTTCGATGAGAACCGGTCCT |

TABLE 9-continued

| ceDNA Vector Name | Nucleic Acid Sequence |
|---|---|
| | GGTATCTGACCGAGAACATCCAGCGGTTTCTGCCCAATCCTGCCGGGGTGCAACTGGAAGATCCTGAGTTCCAGGCAAGCAACATCATGCACTCCATC |
| | AATGGCTATGTGTTCGACAGCCTGCAGCTGAGCGTGTGCCTGCACGAAGTGGCCTACTGGTACATCCTGAGCATTGGCGCCCAGACCGACTTCCTGTC |
| | CGTGTTCTTTAGCGGCTACACCTTCAAGCACAAGATGGTGTACGAGGATACCCTGACACTGTTCCCATTCAGCGGCGAGACAGTGTTCATGAGCATGG |
| | AAAACCCCGGCCTGTGGATTCTGGGCTGTCACAACAGCGACTTCCGGAACAGAGGCATGACAGCCCTGCTGAAGGTGTCCAGCTGCGACAAGAACACC |
| | GGCGACTACTACGAGGACAGCTATGAGGACATCAGCGCCTACCTGCTGAGCAAGAACAATGCCATCGAGCCCAGAAGCTTCAGCCAGAATAGCAGACA |
| | CCCCTCCACCAGACAGAAGCAGTTCAACGCCACAACAATCCCCGAGAACGACATCGAGAAAACCGATCCTTGGTTTGCCCACAGAACCCCTATGCCTA |
| | AGATCCAGAACGTGTCCTCCAGCGATCTGCTGATGCTCCTGAGACAGAGCCCTACACCTCACGGACTGAGCCTGTCCGATCTGCAAGAGGCCAAATAC |
| | GAAACCTTCAGCGACGACCCTTCTCCTGGCGCCATCGACAGCAACAATAGCCTGAGCGAGATGACCCACTTCAGACCACAGCTGCACCACAGCGGCGA |
| | CATGGTGTTTACACCTGAGAGCGGCCTCCAGCTGAGACTGAATGAGAAGCTGGGAACCACCGCCGCCACCGAGCTGAAGAAACTGGACTTCAAGGTGT |
| | CCTCTACCAGCAACAACCTGATCAGCACAATCCCCTCCGACAACCTGGCTGCCGGCACCGACAACACATCTTCTCTGGGCCCACCTAGCATGCCCGTG |
| | CACTACGATAGCCAGCTGGATACCACACTGTTCGGCAAGAAGTCTAGCCCTCTGACAGAGTCTGGCGGCCCTCTGTCTCTGAGCGAGGAAAACAACGA |
| | CAGCAAGCTGCTGGAATCCGGCCTGATGAACAGCCAAGAGTCCTCCTGGGGCAAGAATGTGTCCAGCACCGAGTCCGGCAGACTGTTCAAGGGAAAGA |
| | GAGCCCACGGACCTGCTCTGCTGACCAAGGATAACGCCCTGTTCAAAGTGTCCATCAGCCTGCTCAAGACCAACAAGACCTCCAACAACTCCGCCACC |
| | AACAGAAAGACCCACATCGACGGCCCTAGCCTGCTGATCGAGAATAGCCCTAGCGTCTGGCAGAATATCCTGGAAAGCGACACCGAGTTCAAGAAAGT |
| | GACCCCTCTGATCCACGACCGGATGCTCATGGACAAGAACGCCACCGCTCTGCGGCTGAACCACATGAGCAACAAGACAACCAGCAGCAAGAATATGG |
| | AAATGGTGCAGCAGAAGAAAGAGGGCCCCATTCCTCCAGACGCTCAGAACCCCGATATGAGCTTCTTCAAGATGCTCTTTCTGCCCGAGAGCGCCCGG |
| | TGGATTCAGAGAACACACGGCAAGAACTCCCTGAACTCCGGCCAGGGACCTTCTCCAAAGCAGCTGGTTTCCCTGGGACCTGAGAAGTCCGTGGAAGG |
| | ACAGAACTTCCTGAGCGAAAAGAACAAAGTGGTCGTCGGCAAGGGCGAGTTCACCAAGGATGTGGGCCTGAAAGAGATGGTCTTTCCCAGCAGCCGGA |
| | ACCTGTTCCTGACCAACCTGGACAACCTGCACGAGAACAACACCCACAATCAAGAGAAGAAGATCCAAGAGGAAATCGAAAAGAAAGAGACACTCATC |
| | CAAGAGAACGTGGTGCTGCCTCAGATCCACACAGTGACCGGCACCAAGAACTTTATGAAGAATCTGTTCCTGCTGAGTACCCGGCAGAACGTGGAAGG |
| | CAGCTACGATGGCGCTTATGCCCCTGTGCTGCAGGACTTCAGATCCCTGAACGACTCCACCAATCGGACAAAGAAGCACACAGCCCACTTCTCCAAGA |
| | AGGGCGAAGAAGAGAACCTGGAAGGACTGGGCAATCAGACCAAGCAGATCGTCGAGAAGTACGCCTGCACCACCAGAATCAGCCCCAACACAAGCCAG |
| | CAGAACTTCGTGACCCAGCGGAGCAAAAGAGCCCTGAAGCAGTTTCGGCTGCCCCTGGAAGAAACCGAGCTGGAAAAGCGGATCATCGTGGACGACAC |
| | CAGCACACAGTGGTCCAAGAACATGAAGCACTTGACCCCTAGCACACTGACCCAGATCGACTACAACGAGAAAGAGAAGGGCGCTATCACACAGAGCC |
| | CACTGAGCGACTGTCTGACCAGAAGCCACAGCATCCCTCAGGCCAACAGATCCCCTCTGCCAATCGCCAAAGTGTCTAGCTTCCCCAGCATCAGACCC |
| | ATCTACCTGACCAGAGTGCTGTTCCAGGACAACAGCAGCCATCTGCCAGCCGCCAGCTACCGGAAGAAAGATTCTGGCGTGCAAGAGAGCAGCCACTT |
| | TCTGCAGGGCGCTAAGAAGAACAATCTGAGCCTGGCTATTCTGACCCTGGAAATGACCGGCGATCAGAGAGAAGTCGGCTCTCTGGGCACCAGCGCCA |
| | CAAATAGCGTGACCTACAAAAAGGTGGAAAACACCGTGCTGCCTAAGCCTGACCTGCCAAAGACAAGCGGCAAGGTGGAACTGCTGCCAAAGGTGCAC |
| | ATCTACCAGAAGGACCTGTTTCCTACCGAGACAAGCAACGGCTCTCCCGGCCATCTGGATCTGGTGGAAGGATCTCTGCTGCAGGGAACCGAGGGCGC |
| | CATCAAGTGGAACGAGGCCAATAGACCTGGCAAGGTGCCCTTCCTGAGAGTGGCCACAGAGTCCAGCGCCAAGACACCCTCTAAACTGCTGGACCCTC |
| | TGGCCTGGGACAACCACTATGGCACTCAGATCCCCAAAGAGGAATGGAAGTCCCAAGAGAAGTCCCCTGAAAAGACCGCCTTCAAGAAGAAGGACACC |
| | ATTCTGTCCCTGAATGCCTGCGAGAGCAACCACGCCATTGCCGCCATCAATGAGGGCCAGAACAAGCCCGAGATCGAAGTGACCTGGGCCAAGCAGGG |
| | AAGAACCGAGAGACTGTGTAGCCAGAATCCTCCTGTGCTGAAGCGGCACCAGAGAGAAATCACCCGGACCACACTGCAGAGCGACCAAGAAGAGATCG |
| | ATTACGACGATACCATCAGCGTCGAGATGAAGAAAGAAGATTTCGACATCTACGACGAGGACGAGAATCAGAGCCCTCGGAGCTTCCAGAAGAAAACC |
| | AGGCACTACTTTATTGCCGCCGTCGAGCGGCTGTGGGACTACGGAATGTCTAGCTCTCCTCACGTGCTGCGGAATAGAGCCCAGTCTGGTAGCGTGCC |
| | CCAGTTCAAAAAGGTCGTGTTCCAAGAGTTCACCGACGGCAGCTTCACCCAGCCACTGTATAGAGGCGAGCTGAACGAGCATCTGGGCCTGCTGGGCC |
| | CTTATATCAGAGCCGAAGTGGAAGATAACATCATGGTCACCTTCCGGAATCAGGCTAGCCGGCCTTACAGCTTCTACAGCTCCCTGATCTCCTACGAA |
| | GAGGACCAGAGACAGGGCGCAGAGCCCCGGAAGAATTTCGTGAAGCCCAACGAGACTAAGACCTACTTTTGGAAGGTGCAGCACCATATGGCCCCTAC |
| | AAAGGACGAGTTCGACTGCAAAGCCTGGGCCTACTTCTCCGATGTGGACCTCGAAAAGGACGTGCACAGCGGACTCATCGGCCCACTGCTTGTGTGCC |
| | ACACCAACACACTGAACCCCGCTCACGGCAGACAAGTGACAGTGCAAGAGTTCGCCCTGTTTTTCACCATCTTCGACGAAACGAAGTCCTGGTACTTC |
| | ACCGAAAACATGGAAAGAAACTGCAGGGCCCCTTGCAACATTCAGATGGAAGATCCCACCTTCAAAGAGAACTACCGGTTCCACGCCATCAACGGCTA |
| | CATCATGGACACACTGCCCGGCCTGGTTATGGCCCAGGATCAGAGAATCCGGTGGTATCTGCTGTCCATGGGCTCCAACGAGAATATCCACTCCATCC |
| | ACTTCAGCGGCCACGTGTTCACCGTGCGGAAAAAAGAAGAGTACAAAATGGCCCTGTACAATCTGTACCCTGGGGTGTTCGAAACCGTTGAGATGCTG |
| | CCTAGCAAGGCCGGAATTTGGAGAGTGGAATGTCTGATTGGAGAGCACCTCCACGCCGGGATGAGCACCCTGTTTCTGGTGTACTCCAACAAGTGTCA |
| | GACCCCTCTCGGCATGGCCTCTGGCCACATTAGAGACTTCCAGATCACCGCCAGCGGACAGTATGGACAGTGGGCCCCTAAACTGGCCAGACTGCACT |
| | ACTCCGGCAGCATCAATGCCTGGTCCACCAAAGAGCCTTTCAGCTGGATCAAAGTGGACCTGCTGGCTCCCATGATCATCCACGGAATCAAGACCCAG |
| | GGCGCCAGACAAAAGTTCAGCAGCCTGTACATCAGCCAGTTCATCATCATGTACAGCCTGGACGGAAAGAAGTGGCAGACCTACCGGGGCAATAGCAC |
| | CGGCACACTGATGGTGTTCTTCGGCAACGTGGACTCCAGCGGCATTAAGCACAACATCTTCAACCCTCCAATCATTGCCCGGTACATCCGGCTGCACC |
| | CCACACACTACAGCATCAGGTCTACCCTGAGAATGGAACTGATGGGCTGCGACCTGAACAGCTGCTCTATGCCCCTCGGAATGGAAAGCAAGGCCATC |
| | AGCGACGCCCAGATCACAGCCTCTAGCTACTTCACCAACATGTTCGCCACTTGGAGCCCCTCTAAGGCCCGGCTTCATCTGCAAGGCAGAAGCAACGC |

TABLE 9-continued

| ceDNA Vector Name | Nucleic Acid Sequence |
|---|---|
| | TTGGAGGCCCCAAGTGAACAACCCCAAAGAATGGCTCCAGGTGGACTTTCAGAAAACCATGAAAGTGACAGGCGTGACCACACAGGGCGTCAAGTCCC<br>TGCTGACCTCTATGTACGTGAAAGAGTTTCTGATCAGCTCCAGCCAGGACGGCCACCAGTGGACCCTGTTCTTCCAGAACGGCAAAGTGAAAGTGTTC<br>CAGGGAAATCAGGACAGCTTCACACCCGTGGTCAATAGTCTGGACCCACCACTGCTGACCCGCTACCTGCGAATTCACCCTCAGTCTTGGGTGCACCA<br>GATTGCCCTGCGGATGGAAGTGCTGGGCTGTGAAGCTCAGGACCTCTACTAGTTAATTAAGAGCATCTTACCGCCATTTATTCCCATATTTGTTCTGT<br>TTTTCTTGATTTGGGTATACATTTAAATGTTAATAAAACAAAATGGTGGGGCAATCATTTACATTTTTAGGGATATGTAATTACTAGTTCAGGTGTAT<br>TGCCACAAGACAAACATGTTAAGAAACTTTCCCGTTATTTACGCTCTGTTCCTGTTAATCAACCTCTGGATTACAAAATTTGTGAAAGATTGACTGAT<br>ATTCTTAACTATGTTGCTCCTTTTACGCTGTGTGGATATGCTGCTTTATAGCCTCTGTATCTAGCTATTGCTTCCCGTACGGCTTTCGTTTTCTCCTC<br>CTTGTATAAATCCTGGTTGCTGTCTCTTTTAGAGGAGTTGTGGCCCGTTGTCCGTCAACGTGGCGTGGTGTGCTCTGTGTTTGCTGACGCAACCCCCA<br>CTGGCTGGGGCATTGCCACCACCTGTCAACTCCTTTCTGGGACTTTCGCTTTCCCCCTCCCGATCGCCACGGCAGAACTCATCGCCGCCTGCCTTGCC<br>CGCTGCTGGACAGGGGCTAGGTTGCTGGGCACTGATAATTCCGTGGTGTTGTCTGTGCCTTCTAGTTGCCAGCCATCTGTTGTTTGCCCCTCCCCCGT<br>GCCTTCCTTGACCCTGGAAGGTGCCACTCCCACTGTCCTTTCCTAATAAAATGAGGAAATTGCATCGCATTGTCTGAGTAGGTGTCATTCTATTCTGG<br>GGGGTGGGGTGGGGCAGGACAGCAAGGGGGAGGATTGGGAAGACAATAGCAGGCATGCTGGGGATGCGGTGGGCTCTATGGCTCTAGAGCATGGCTAC<br>GTAGATAAGTAGCATGGCGGGTTAATCATTAACTACACCTGCAGGAGGAACCCCTAGTGATGGAGTTGGCCACTCCCTCTCTGCGCGCTCGCTCGCTC<br>ACTGAGGCCGGGCGACCAAAGGTCGCCCGACGCCCGGGCGGCCTCAGTGAGCGAGCGAGCGCGCAGCTGCCTGCAGGGGCGCGCCTCGAGGCATGCGG<br>TACCAAGCTTGTCGAGAAGTACTAGAGGATCATAATCAGCCATACCACATTTGTAGAGGTTTTACTTGCTTTAAAAAACCTCCCACACCTCCCCCTGA<br>ACCTGAAACATAAAATGAATGCAATTGTTGTTGTTAACTTGTTTATTGCAGCTTATAATGGTTACAAATAAAGCAATAGCATCACAAATTTCACAAAT<br>AAAGCATTTTTTTCACTGCATTCTAGTTGTGGTTTGTCCAAACTCATCAATGTATCTTATCATGTCTGGATCTGATCACTGATATCGCCTAGGAGATC<br>CGAACCAGATAAGTGAAATCTAGTTCCAAACTATTTTGTCATTTTTAATTTTCGTATTAGCTTACGACGCTACACCCAGTTCCCATCTATTTTGTCAC<br>TCTTCCCTAAATAATCCTTAAAAACTCCATTTCCACCCCTCCCAGTTCCCAACTATTTTGTCCGCCCACAGCGGGGCATTTTTCTTCCTGTTATGTTT<br>TTAATCAAACATCCTGCCAACTCCATGTGACAAACCGTCATCTTCGGCTACTTTTTCTCTGTCACAGAATGAAAATTTTTCTGTCATCTCTTCGTTAT<br>TAATGTTTGTAATTGACTGAATATCAACGCTTATTTGCAGCCTGAATGGCGAATGG |
| ceDNAFVIII-vector 6 (SEQ ID NO: 197) | GACGCGCCCTGTAGCGGCGCATTAAGCGCGGCGGGTGTGGTGGTTACGCGCAGCGTGACCGCTACACTTGCCAGCGCCCTAGCGCCCGCTCCTTTCGC<br>TTTCTTCCCTTCCTTTCTCGCCACGTTCGCCGGCTTTCCCCGTCAAGCTCTAAATCGGGGGCTCCCTTTAGGGTTCCGATTTAGTGCTTTACGGCACC<br>TCGACCCCAAAAAACTTGATTAGGGTGATGGTTCACGTAGTGGGCCATCGCCCTGATAGACGGTTTTTCGCCCTTTGACGTTGGAGTCCACGTTCTTT<br>AATAGTGGACTCTTGTTCCAAACTGGAACAACACTCAACCCTATCTCGGTCTATTCTTTTGATTTATAAGGGATTTTGCCGATTTCGGCCTATTGGTT<br>AAAAAATGAGCTGATTTAACAAAAATTTAACGCGAATTTTAACAAAATATTAACGTTTACAATTTCAGGTGGCACTTTTCGGGGAAATGTGCGCGGAA<br>CCCCTATTTGTTTATTTTTCTAAATACATTCAAATATGTATCCGCTCATGAGACAATAACCCTGATAAATGCTTCAATAATATTGAAAAAGGAAGAGT<br>ATGAGTATTCAACATTTCCGTGTCGCCCTTATTCCCTTTTTTGCGGCATTTTGCCTTCCTGTTTTTGCTCACCCAGAAACGCTGGTGAAAGTAAAAGA<br>TGCTGAAGATCAGTTGGGTGCACGAGTGGGTTACATCGAACTGGATCTCAACAGCGGTAAGATCCTTGAGAGTTTTCGCCCCGAAGAACGTTTTCCAA<br>TGATGAGCACTTTTAAAGTTCTGCTATGTGGCGCGGTATTATCCCGTATTGACGCCGGGCAAGAGCAACTCGGTCGCCGCATACACTATTCTCAGAAT<br>GACTTGGTTGAGTACTCACCAGTCACAGAAAAGCATCTTACGGATGGCATGACAGTAAGAGAATTATGCAGTGCTGCCATAACCATGAGTGATAACAC<br>TGCGGCCAACTTACTTCTGACAACGATCGGAGGACCGAAGGAGCTAACCGCTTTTTTGCACAACATGGGGGATCATGTAACTCGCCTTGATCGTTGGG<br>AACCGGAGCTGAATGAAGCCATACCAAACGACGAGCGTGACACCACGATGCCTGTAGCAATGGCAACAACGTTGCGCAAACTATTAACTGGCGAACTA<br>CTTACTCTAGCTTCCCGGCAACAATTAATAGACTGGATGGAGGCGGATAAAGTTGCAGGACCACTTCTGCGCTCGGCCCTTCCGGCTGGCTGGTTTAT<br>TGCTGATAAATCTGGAGCCGGTGAGCGTGGGTCTCGCGGTATCATTGCAGCACTGGGGCCAGATGGTAAGCCCTCCCGTATCGTAGTTATCTACACGA<br>CGGGGAGTCAGGCAACTATGGATGAACGAAATAGACAGATCGCTGAGATAGGTGCCTCACTGATTAAGCATTGGTAACTGTCAGACCAAGTTTACTCA<br>TATATACTTTAGATTGATTTAAAACTTCATTTTTAATTTAAAAGGATCTAGGTGAAGATCCTTTTTGATAATCTCATGACCAAAATCCCTTAACGTGA<br>GTTTTCGTTCCACTGAGCGTCAGACCCCGTAGAAAAGATCAAAGGATCTTCTTGAGATCCTTTTTTTCTGCGCGTAATCTGCTGCTTGCAAACAAAAA<br>AACCACCGCTACCAGCGGTGGTTTGTTTGCCGGATCAAGAGCTACCAACTCTTTTTCCGAAGGTAACTGGCTTCAGCAGAGCGCAGATACCAAATACT<br>GTCCTTCTAGTGTAGCCGTAGTTAGGCCACCACTTCAAGAACTCTGTAGCACCGCCTACATACCTCGCTCTGCTAATCCTGTTACCAGTGGCTGCTGC<br>CAGTGGCGATAAGTCGTGTCTTACCGGGTTGGACTCAAGACGATAGTTACCGGATAAGGCGCAGCGGTCGGGCTGAACGGGGGGTTCGTGCACACAGC<br>CCAGCTTGGAGCGAACGACCTACACCGAACTGAGATACCTACAGCGTGAGCATTGAGAAAGCGCCACGCTTCCCGAAGGGAGAAAGGCGGACAGGTAT<br>CCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTG<br>ACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGC<br>CTTTTGCTCACATGTTCTTTCCTGCGTTATCCCCTGATTCTGTGGATAACCGTATTACCGCCTTTGAGTGAGCTGATACCGCTCGCCGCAGCCGAACG<br>ACCGAGCGCAGCGAGTCAGTGAGCGAGGAAGCGGAAGAGCGCCTGATGCGGTATTTTCTCCTTACGCATCTGTGCGGTATTTCACACCGCAGACCAGC<br>CGCGTAACCTGGCAAAATCGGTTACGGTTGAGTAATAAATGGATGCCCTGCGTAAGCGGGTGTGGGCGGACAATAAAGTCTTAAACTGAACAAAATAG<br>ATCTAAACTATGACAATAAAGTCTTAAACTAGACAGAATAGTTGTAAACTGAAATCAGTCCAGTTATGCTGTGAAAAAGCATACTGGACTTTTGTTAT<br>GGCTAAAGCAAACTCTTCATTTTCTGAAGTGCAAATTGCCCGTCGTATTAAAGAGGGGCGTGGCCAAGGGCATGGTAAAGACTATATTCGCGGCGTTG |

TABLE 9-continued

| ceDNA Vector Name | Nucleic Acid Sequence |
|---|---|
| | TGACAATTTACCGAACAACTCCGCGGCCGGGAAGCCGATCTCGGCTTGAACGAATTGTTAGGTGGCGGTACTTGGGTCGATATCAAAGTGCATCACTT<br>CTTCCCGTATGCCCAACTTTGTATAGAGAGCCACTGCGGGATCGTCACCGTAATCTGCTTGCACGTAGATCACATAAGCACCAAGCGCGTTGGCCTCA<br>TGCTTGAGGAGATTGATGAGCGCGGTGGCAATGCCCTGCCTCCGGTGCTCGCCGGAGACTGCGAGATCATAGATATAGATCTCACTACGCGGCTGCTC<br>AAACCTGGGCAGAACGTAAGCCGCGAGAGCGCCAACAACCGCTTCTTGGTCGAAGGCAGCAAGCGCGATGAATGTCTTACTACGGAGCAAGTTCCCGA<br>GGTAATCGGAGTCCGGCTGATGTTGGGAGTAGGTGGCTACGTCTCCGAACTCACGACCGAAAAGATCAAGAGCAGCCCGCATGGATTTGACTTGGTCA<br>GGGCCGAGCCTACATGTGCGAATGATGCCCATACTTGAGCCACCTAACTTTGTTTTAGGGCGACTGCCCTGCTGCGTAACATCGTTGCTGCTGCGTAA<br>CATCGTTGCTGCTCCATAACATCAAACATCGACCCACGGCGTAACGCGCTTGCTGCTTGGATGCCCGAGGCATAGACTGTACAAAAAAACAGTCATAA<br>CAAGCCATGAAAACCGCCACTGCGCCGTTACCACCGCTGCGTTCGGTCAAGGTTCTGGACCAGTTGCGTGAGCGCATACGCTACTTGCATTACAGTTT<br>ACGAACCGAACAGGCTTATGTCAACTGGGTTCGTGCCTTCATCCGTTTCCACGGTGTGCGTCACCCGGCAACCTTGGGCAGCAGCGAAGTCGAGGCAT<br>TTCTGTCCTGGCTGGCGAACGAGCGCAAGGTTTCGGTCTCCACGCATCGTCAGGCATTGGCGGCCTTGCTGTTCTTCTACGGCAAGGTGCTGTGCACG<br>GATCTGCCCTGGCTTCAGGAGATCGGAAGACCTCGGCCGTCGCGGCGCTTGCCGGTGGTGCTGACCCCGGATGAAGTGGTTCGCATCCTCGGTTTTCT<br>GGAAGGCGAGCATCGTTTGTTCGCCCAGGACTCTAGCTATAGTTCTAGTGGTTGGCTACGTATACTCCGGAATATTAATAGATCATGGAGATAATTAA<br>AATGATAACCATCTCGCAAATAAATAAGTATTTTACTGTTTTCGTAACAGTTTTGTAATAAAAAAACCTATAAATATTCCGGATTATTCATACCGTCC<br>CACCATCGGGCGCGGATCTCGGTCCGAAACCATGTCGTACTACCATCACCATCACCATCACGATTACGATATCCCAACGACCGAAAACCTGTATTTTC<br>AGGGCGCCATGGGATCCGGCCGGCCCCTGCAGGCAGCTGCGCGCTCGCTCGCTCACTGAGGCCGCCCGGGCAAAGCCCGGGCGTCGGGCGACCTTTGG<br>TCGCCCGGCCTCAGTGAGCGAGCGAGCGCGCAGAGAGGGAGTGGCCAACTCCATCACTAGGGGTTCCTTGTAGTTAATGATTAACCCGCCATGCTACT<br>TATCTACGTAGCCATGCTCTAGAGCGGCCGC**GGCTCCGGTGCCCGTCAGTGGGCAGAGCGCACATCGCCCACAGTCCCCGAGAAGTTGGGGGGAGGGG**<br>**TCGGCAATTGAACCGGTGCCTAGAGAAGGTGGCGCGGGGTAAACTGGGAAAGTGATGTCGTGTACTGGCTCCGCCTTTTTCCCGAGGGTGGGGGAGAA**<br>**CCGTATATAAGTGCAGTAGTCGCCGTGAACGTTCTTTTTCGCAACGGGTTTGCCGCCAGAACACAGGTAAGTGCCGTGTGTGGTTCCCGC**GGGCCTGG<br>CCTCTTTACGGGTTATGGCCCTTGCGTGCCTTGAATTACTTCCACCTGGCTGCAGTACGTGATTCTTGATCCCGAGCTTCGGGTTGGAAGTGGGTGGG<br>AGAGTTCGAGGCCTTGCGCTTAAGGAGCCCCTTCGCCTCGTGCTTGAGTTGAGGCCTGGCCTGGGCGCTGGGGCCGCCGCGTGCGAATCTGGTGGCAC<br>CTTCGCGCCTGTCTCGCTGCTTTCGATAAGTCTCTAGCCATTTAAAATTTTTGATGACCTGCTGCGACGCTTTTTTTCTGGCAAGATAGTCTTGTAAA<br>TGCGGGCCAAGATCTGCACACTGGTATTTCGGTTTTTGGGGCCGCGGGCGGCGACGGGGCCCGTGCGTCCCAGCGCACATGTTCGGCGAGGCGGGGCC<br>TGCGAGCGCGGCCACCGAGAATCGGACGGGGGTAGTCTCAAGCTGGCCGGCCTGCTCTGGTGCCTGGTCTCGCGCCGCCGTGTATCGCCCCGCCCTGG<br>GCGGCAAGGCTGGCCCGGTCGGCACCAGTTGCGTGAGCGGAAAGATGGCCGCTTCCCGGCCCTGCTGCAGGGAGCTCAAAATGGAGGACGCGGCGCTC<br>GGGAGAGCGGGCGGGTGAGTCACCCACACAAAGGAAAAGGGCCTTTCCGTCCTCAGCCGTCGCTTCATGTGACTCCACGGAGTACCGGGCGCCGTCCA<br>GGCACCTCGATTAGTTCTCGAGCTTTTGGAGTACGTCGTCTTTAGGTTGGGGGGAGGGGTTTTATGCGATGGAGTTTCCCCACACTGAGTGGGTGGAG<br>ACTGAAGTTAGGCCAGCTTGGCACTTGATGTAATTCTCCTTGGAATTTGCCCTTTTTGAGTTTGGATCTTGGTTCATTCTCAAGCCTCAGACAGTGGT<br>TCAAAGTTTTTTTCTTCCATTTCAGGTGTCGTGAGTTTAAACCGCAGCCACCATGCAGATCGAGCTGTCTACCTGCTTCTTCCTGTGCCTGCTGCGGT<br>TCTGCTTCAGCGCCACCAGAAGATATTACCTGGGCGCCGTGGAACTGAGCTGGGACTACATGCAGTCTGACCTGGGAGAGCTGCCCGTGGACGCTAGA<br>TTTCCTCCAAGAGTGCCCAAGAGCTTCCCCTTCAACACCTCCGTGGTGTACAAGAAAACCCTGTTCGTGGAATTCACCGACCACCTGTTCAATATCGC<br>CAAGCCTCGGCCTCCTTGGATGGGACTGCTGGGACCTACAATTCAGGCCGAGGTGTACGACACCGTGGTCATCACCCTGAAGAACATGGCCAGCCATC<br>CTGTGTCTCTGCACGCCGTGGGAGTGTCTTATTGGAAGGCTTCTGAGGGCGCCGAGTACGACGATCAGACAAGCCAGAGAGAGAAAGAGGACGACAAG<br>GTTTTCCCTGGCGGCAGCCACACCTATGTCTGGCAGGTCCTGAAAGAAAACGGCCCTATGGCCTCCGATCCTCTGTGCCTGACATACAGCTACCTGAG<br>CCACGTGGACCTGGTCAAGGACCTGAATTCTGGCCTGATCGGAGCCCTGCTCGTGTGTAGAGAAGGCAGCCTGGCCAAAGAGAAAACCCAGACACTGC<br>ACAAGTTCATCCTGCTGTTCGCCGTGTTCGACGAGGGCAAGAGCTGGCACAGCGAGACAAAGAACAGCCTGATGCAGGACAGGGATGCCGCCTCTGCT<br>AGAGCTTGGCCTAAGATGCACACCGTGAACGGCTACGTGAACAGAAGCCTGCCTGGACTGATCGGCTGCCACAGAAAGTCCGTGTACTGGCACGTGAT<br>CGGCATGGGCACAACACCTGAGGTGCACAGCATCTTTCTGGAAGGCCACACCTTCCTCGTGCGGAACCACAGACAGGCCAGCCTGGAAATCAGCCCTA<br>TCACCTTCCTGACCGCTCAGACCCTGCTGATGGATCTGGGCCAGTTTCTGCTGTTCTGCCACATCAGCTCCCACCAGCACGATGGCATGGAAGCCTAC<br>GTGAAGGTGGACAGCTGCCCCGAAGAACCCCAGCTGCGGATGAAGAACAACGAGGAAGCCGAGGACTACGACGACGACCTGACCGACTCTGAGATGGA<br>CGTCGTCAGATTCGACGACGATAACAGCCCCAGCTTCATCCAGATCAGAAGCGTGGCCAAGAAGCACCCCAAGACCTGGGTGCACTATATCGCCGCCG<br>AGGAAGAGGACTGGGATTACGCTCCTCTGGTGCTGGCCCCTGACGACAGAAGCTACAAGAGCCAGTACCTGAACAACGGCCCTCAGCGGATCGGCCGG<br>AAGTATAAGAAAGTGCGGTTCATGGCCTACACCGACGAGACATTCAAGACCAGAGAGGCCATCCAGCACGAGAGCGGAATTCTGGGCCCTCTGCTGTA<br>TGGCGAAGTGGGCGATACACTGCTGATCATCTTCAAGAACCAGGCCAGCAGACCCTACAACATCTACCCTCACGGCATCACCGATGTGCGGCCCCTGT<br>ATTCTAGAAGGCTGCCCAAGGGCGTGAAGCACCTGAAGGACTTCCCTATCCTGCCTGGCGAGATTTTCAAGTACAAGTGGACCGTGACCGTGGAAGAT<br>GGCCCCACCAAGAGCGACCCTAGATGTCTGACACGGTACTACAGCAGCTTCGTGAACATGGAACGCGACCTGGCCAGCGGCCTGATTGGACCTCTGCT<br>GATCTGCTACAAAGAAAGCGTGGACCAGCGGGGCAACCAGATCATGAGCGACAAGCGGAACGTGATCCTGTTTAGCGTGTTCGATGAGAACCGGTCCT<br>GGTATCTGACCGAGAACATCCAGCGGTTTCTGCCCAATCCTGCCGGGGTGCAACTGGAAGATCCTGAGTTCCAGGCAAGCAACATCATGCACTCCATC<br>AATGGCTATGTGTTCGACAGCCTGCAGCTGAGCGTGTGCCTGCACGAAGTGGCCTACTGGTACATCCTGAGCATTGGCGCCCAGACCGACTTCCTGTC<br>CGTGTTCTTTAGCGGCTACACCTTCAAGCACAAGATGGTGTACGAGGATACCCTGACACTGTTCCCATTCAGCGGCGAGACAGTGTTCATGAGCATGG |

TABLE 9-continued

| ceDNA Vector Name | Nucleic Acid Sequence |
|---|---|
| | AAAACCCCGGCCTGTGGATTCTGGGCTGTCACAACAGCGACTTCCGGAACAGAGGCATGACAGCCCTGCTGAAGGTGTCCAGCTGCGACAAGAACACC<br>GGCGACTACTACGAGGACAGCTATGAGGACATCAGCGCCTACCTGCTGAGCAAGAACAATGCCATCGAGCCTCGGAGCTTCAGCCAGAATCCTCCTGT<br>GCTGAAGCGGCACCAGCGCGAGATCACCAGAACAACCCTGCAGAGCGACCAAGAGGAAATCGATTACGACGACACCATCAGCGTCGAGATGAAGAAAG<br>AAGATTTCGACATCTACGACGAGGACGAGAATCAGAGCCCCAGAAGCTTTCAGAAAAAGACCCGGCACTACTTCATTGCCGCCGTCGAGAGACTGTGG<br>GACTACGGCATGTCTAGCAGCCCTCACGTGCTGAGAAATAGAGCCCAGAGCGGCAGCGTGCCCCAGTTCAAGAAAGTGGTGTTCCAAGAGTTCACCGA<br>CGGCAGCTTCACCCAGCCACTGTATAGAGGCGAGCTGAACGAGCATCTGGGCCTGCTGGGCCCTTATATCAGAGCCGAAGTGGAAGATAACATCATGG<br>TCACCTTCCGGAATCAGGCTAGCCGGCCTTACAGCTTCTACAGCTCCCTGATCAGCTACGAAGAGGACCAGAGACAGGGCGCTGAGCCCAGAAAGAAC<br>TTCGTGAAGCCCAACGAGACTAAGACCTACTTTTGGAAGGTGCAGCACCACATGGCCCCTACAAAGGACGAGTTCGACTGCAAAGCCTGGGCCTACTT<br>CTCCGATGTGGATCTGGAAAAGGACGTGCACAGCGGGCTCATCGGACCACTGCTTGTGTGCCACACCAACACACTGAACCCCGCTCACGGCAGACAAG<br>TGACAGTGCAAGAGTTCGCCCTGTTCTTCACCATCTTCGACGAAACAAAGAGCTGGTACTTCACCGAGAATATGGAACGGAACTGCAGAGCCCCTTGC<br>AACATCCAGATGGAAGATCCCACCTTCAAAGAGAACTACCGGTTCCACGCCATCAACGGCTACATCATGGACACACTGCCCGGCCTGGTTATGGCCCA<br>GGATCAGAGAATCCGGTGGTATCTGCTGTCCATGGGCTCCAACGAGAATATCCACAGCATCCACTTCAGCGGCCACGTGTTCACCGTGCGGAAAAAAG<br>AAGAGTACAAAATGGCCCTGTACAATCTGTACCCTGGGGTGTTCGAAACCGTGGAAATGCTGCCTTCCAAGGCCGGCATTTGGAGAGTGGAATGTCTG<br>ATTGGAGAGCACCTCCACGCCGGAATGAGCACCCTGTTTCTGGTGTACAGCAACAAGTGTCAGACCCCTCTCGGCATGGCCTCTGGACACATCAGAGA<br>CTTCCAGATCACCGCCTCTGGCCAGTACGGACAGTGGGCTCCTAAACTGGCTCGGCTGCACTACAGCGGCAGCATCAATGCCTGGTCCACCAAAGAGC<br>CCTTCAGCTGGATCAAGGTGGACCTGCTGGCTCCCATGATCATCCACGGAATCAAGACCCAGGGCGCCAGACAGAAGTTCAGCAGCCTGTACATCAGC<br>CAGTTCATCATCATGTACAGCCTGGACGGCAAGAAGTGGCAGACCTACAGAGGCAACAGCACCGGCACACTCATGGTGTTCTTCGGCAACGTGGACTC<br>CAGCGGCATTAAGCACAACATCTTCAACCCTCCAATCATTGCCCGGTACATCCGGCTGCACCCCACACACTACAGCATCCGGTCTACCCTGAGAATGG<br>AACTGATGGGCTGCGACCTGAACAGCTGCTCTATGCCCCTCGGAATGGAAAGCAAGGCCATCAGCGACGCCCAGATCACAGCCAGCAGCTACTTCACC<br>AACATGTTCGCCACTTGGAGCCCCTCCAAGGCTAGACTGCATCTGCAGGGCAGAAGCAACGCTTGGAGGCCCCAAGTGAACAACCCCAAAGAGTGGCT<br>GCAGGTTGACTTTCAAAAGACCATGAAAGTGACCGGCGTGACCACACAGGGCGTCAAGTCTCTGCTGACCTCTATGTACGTGAAAGAGTTCCTGATCT<br>CCAGCAGCCAGGACGGCCATCAGTGGACCCTGTTTTTCCAGAACGGCAAAGTGAAAGTGTTCCAGGGCAATCAGGACAGCTTCACACCCGTGGTCAAT<br>TCTCTGGACCCTCCACTGCTGACCAGATACCTGCGGATTCACCCTCAGTCTTGGGTGCACCAGATCGCTCTGCGGATGGAAGTGCTGGGCTGTGAAGC<br>TCAGGACCTCTACTAGTTAATTAAGAGCATCTTACCGCCATTTATTCCCATATTTGTTCTGTTTTTCTTGATTTGGGTATACATTTAAATGTTAATAA<br>AACAAAATGGTGGGGCAATCATTTACATTTTTAGGGATATGTAATTACTAGTTCAGGTGTATTGCCACAAGACAAACATGTTAAGAAACTTTCCCGTT<br>ATTTACGCTCTGTTCCTGTTAATCAACCTCTGGATTACAAAATTTGTGAAAGATTGACTGATATTCTTAACTATGTTGCTCCTTTTACGCTGTGTGGA<br>TATGCTGCTTTATAGCCTCTGTATCTAGCTATTGCTTCCCGTACGGCTTTCGTTTTCTCCTCCTTGTATAAATCCTGGTTGCTGTCTCTTTTAGAGGA<br>GTTGTGGCCCGTTGTCCGTCAACGTGGCGTGGTGTGCTCTGTGTTTGCTGACGCAACCCCCACTGGCTGGGGCATTGCCACCACCTGTCAACTCCTTT<br>CTGGGACTTTCGCTTTCCCCCTCCCGATCGCCACGGCAGAACTCATCGCCGCCTGCCTTGCCCGCTGCTGGACAGGGGCTAGGTTGCTGGGCACTGAT<br>AATTCCGTGGTGTTGTCTGTGCCTTCTAGTTGCCAGCCATCTGTTGTTTGCCCCTCCCCCGTGCCTTCCTTGACCCTGGAAGGTGCCACTCCCACTGT<br>CCTTTCCTAATAAAATGAGGAAATTGCATCGCATTGTCTGAGTAGGTGTCATTCTATTCTGGGGGGTGGGGTGGGGCAGGACAGCAAGGGGGAGGATT<br>GGGAAGACAATAGCAGGCATGCTGGGGATGCGGTGGGCTCTATGGCTCTAGAGCATGGCTACGTAGATAAGTAGCATGGCGGGTTAATCATTAACTAC<br>ACCTGCAGGAGGAACCCCTAGTGATGGAGTTGGCCACTCCCTCTCTGCGCGCTCGCTCGCTCACTGAGGCCGGGCGACCAAAGGTCGCCCGACGCCCG<br>GGCGGCCTCAGTGAGCGAGCGAGCGCGCAGCTGCCTGCAGGGGCGCGCCTCGAGGCATGCGGTACCAAGCTTGTCGAGAAGTACTAGAGGATCATAAT<br>CAGCCATACCACATTTGTAGAGGTTTTACTTGCTTTAAAAAACCTCCCACACCTCCCCCTGAACCTGAAACATAAAATGAATGCAATTGTTGTTGTTA<br>ACTTGTTTATTGCAGCTTATAATGGTTACAAATAAAGCAATAGCATCACAAATTTCACAAATAAAGCATTTTTTTCACTGCATTCTAGTTGTGGTTTG<br>TCCAAACTCATCAATGTATCTTATCATGTCTGGATCTGATCACTGATATCGCCTAGGAGATCCGAACCAGATAAGTGAAATCTAGTTCCAAACTATTT<br>TGTCATTTTTAATTTTCGTATTAGCTTACGACGCTACACCCAGTTCCCATCTATTTTGTCACTCTTCCCTAAATAATCCTTAAAAACTCCATTTCCAC<br>CCCTCCCAGTTCCCAACTATTTTGTCCGCCCACAGCGGGGCATTTTTCTTCCTGTTATGTTTTTAATCAAACATCCTGCCAACTCCATGTGACAAACC<br>GTCATCTTCGGCTACTTTTTCTCTGTCACAGAATGAAAATTTTTCTGTCATCTCTTCGTTATTAATGTTTGTAATTGACTGAATATCAACGCTTATTT<br>GCAGCCTGAATGGCGAATGG |
| ceDNAFVIII-vector 7 (SEQ ID NO: 198) | GACGCGCCCTGTAGCGGCGCATTAAGCGCGGCGGGTGTGGTGGTTACGCGCAGCGTGACCGCTACACTTGCCAGCGCCCTAGCGCCCGCTCCTTTCGC<br>TTTCTTCCCTTCCTTTCTCGCCACGTTCGCCGGCTTTCCCCGTCAAGCTCTAAATCGGGGGCTCCCTTTAGGGTTCCGATTTAGTGCTTTACGGCACC<br>TCGACCCCAAAAAACTTGATTAGGGTGATGGTTCACGTAGTGGGCCATCGCCCTGATAGACGGTTTTTCGCCCTTTGACGTTGGAGTCCACGTTCTTT<br>AATAGTGGACTCTTGTTCCAAACTGGAACAACACTCAACCCTATCTCGGTCTATTCTTTTGATTTATAAGGGATTTTGCCGATTTCGGCCTATTGGTT<br>AAAAAATGAGCTGATTTAACAAAAATTTAACGCGAATTTTAACAAAATATTAACGTTTACAATTTCAGGTGGCACTTTTCGGGGAAATGTGCGCGGAA<br>CCCCTATTTGTTTATTTTTCTAAATACATTCAAATATGTATCCGCTCATGAGACAATAACCCTGATAAATGCTTCAATAATATTGAAAAAGGAAGAGT<br>ATGAGTATTCAACATTTCCGTGTCGCCCTTATTCCCTTTTTTGCGGCATTTTGCCTTCCTGTTTTTGCTCACCCAGAAACGCTGGTGAAAGTAAAAGA<br>TGCTGAAGATCAGTTGGGTGCACGAGTGGGTTACATCGAACTGGATCTCAACAGCGGTAAGATCCTTGAGAGTTTTCGCCCCGAAGAACGTTTTCCAA |

TABLE 9-continued

| ceDNA Vector Name | Nucleic Acid Sequence |
|---|---|
| | TGATGAGCACTTTTAAAGTTCTGCTATGTGGCGCGGTATTATCCCGTATTGACGCCGGGCAAGAGCAACTCGGTCGCCGCATACACTATTCTCAGAAT<br>GACTTGGTTGAGTACTCACCAGTCACAGAAAAGCATCTTACGGATGGCATGACAGTAAGAGAATTATGCAGTGCTGCCATAACCATGAGTGATAACAC<br>TGCGGCCAACTTACTTCTGACAACGATCGGAGGACCGAAGGAGCTAACCGCTTTTTTGCACAACATGGGGGATCATGTAACTCGCCTTGATCGTTGGG<br>AACCGGAGCTGAATGAAGCCATACCAAACGACGAGCGTGACACCACGATGCCTGTAGCAATGGCAACAACGTTGCGCAAACTATTAACTGGCGAACTA<br>CTTACTCTAGCTTCCCGGCAACAATTAATAGACTGGATGGAGGCGGATAAAGTTGCAGGACCACTTCTGCGCTCGGCCCTTCCGGCTGGCTGGTTTAT<br>TGCTGATAAATCTGGAGCCGGTGAGCGTGGGTCTCGCGGTATCATTGCAGCACTGGGGCCAGATGGTAAGCCCTCCCGTATCGTAGTTATCTACACGA<br>CGGGGAGTCAGGCAACTATGGATGAACGAAATAGACAGATCGCTGAGATAGGTGCCTCACTGATTAAGCATTGGTAACTGTCAGACCAAGTTTACTCA<br>TATATACTTTAGATTGATTTAAAACTTCATTTTTAATTTAAAAGGATCTAGGTGAAGATCCTTTTTGATAATCTCATGACCAAAATCCCTTAACGTGA<br>GTTTTCGTTCCACTGAGCGTCAGACCCCGTAGAAAAGATCAAAGGATCTTCTTGAGATCCTTTTTTTCTGCGCGTAATCTGCTGCTTGCAAACAAAAA<br>AACCACCGCTACCAGCGGTGGTTTGTTTGCCGGATCAAGAGCTACCAACTCTTTTTCCGAAGGTAACTGGCTTCAGCAGAGCGCAGATACCAAATACT<br>GTCCTTCTAGTGTAGCCGTAGTTAGGCCACCACTTCAAGAACTCTGTAGCACCGCCTACATACCTCGCTCTGCTAATCCTGTTACCAGTGGCTGCTGC<br>CAGTGGCGATAAGTCGTGTCTTACCGGGTTGGACTCAAGACGATAGTTACCGGATAAGGCGCAGCGGTCGGGCTGAACGGGGGGTTCGTGCACACAGC<br>CCAGCTTGGAGCGAACGACCTACACCGAACTGAGATACCTACAGCGTGAGCATTGAGAAAGCGCCACGCTTCCCGAAGGGAGAAAGGCGGACAGGTAT<br>CCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTG<br>ACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGC<br>CTTTTGCTCACATGTTCTTTCCTGCGTTATCCCCTGATTCTGTGGATAACCGTATTACCGCCTTTGAGTGAGCTGATACCGCTCGCCGCAGCCGAACG<br>ACCGAGCGCAGCGAGTCAGTGAGCGAGGAAGCGGAAGAGCGCCTGATGCGGTATTTTCTCCTTACGCATCTGTGCGGTATTTCACACCGCAGACCAGC<br>CGCGTAACCTGGCAAAATCGGTTACGGTTGAGTAATAAATGGATGCCCTGCGTAAGCGGGTGTGGGCGGACAATAAAGTCTTAAACTGAACAAAATAG<br>ATCTAAACTATGACAATAAAGTCTTAAACTAGACAGAATAGTTGTAAACTGAAATCAGTCCAGTTATGCTGTGAAAAAGCATACTGGACTTTTGTTAT<br>GGCTAAAGCAAACTCTTCATTTTCTGAAGTGCAAATTGCCCGTCGTATTAAAGAGGGGCGTGGCCAAGGGCATGGTAAAGACTATATTCGCGGCGTTG<br>TGACAATTTACCGAACAACTCCGCGGCCGGGAAGCCGATCTCGGCTTGAACGAATTGTTAGGTGGCGGTACTTGGGTCGATATCAAAGTGCATCACTT<br>CTTCCCGTATGCCCAACTTTGTATAGAGAGCCACTGCGGGATCGTCACCGTAATCTGCTTGCACGTAGATCACATAAGCACCAAGCGCGTTGGCCTCA<br>TGCTTGAGGAGATTGATGAGCGCGGTGGCAATGCCCTGCCTCCGGTGCTCGCCGGAGACTGCGAGATCATAGATATAGATCTCACTACGCGGCTGCTC<br>AAACCTGGGCAGAACGTAAGCCGCGAGAGCGCCAACAACCGCTTCTTGGTCGAAGGCAGCAAGCGCGATGAATGTCTTACTACGGAGCAAGTTCCCGA<br>GGTAATCGGAGTCCGGCTGATGTTGGGAGTAGGTGGCTACGTCTCCGAACTCACGACCGAAAAGATCAAGAGCAGCCCGCATGGATTTGACTTGGTCA<br>GGGCCGAGCCTACATGTGCGAATGATGCCCATACTTGAGCCACCTAACTTTGTTTTAGGGCGACTGCCCTGCTGCGTAACATCGTTGCTGCTGCGTAA<br>CATCGTTGCTGCTCCATAACATCAAACATCGACCCACGGCGTAACGCGCTTGCTGCTTGGATGCCCGAGGCATAGACTGTACAAAAAAACAGTCATAA<br>CAAGCCATGAAAACCGCCACTGCGCCGTTACCACCGCTGCGTTCGGTCAAGGTTCTGGACCAGTTGCGTGAGCGCATACGCTACTTGCATTACAGTTT<br>ACGAACCGAACAGGCTTATGTCAACTGGGTTCGTGCCTTCATCCGTTTCCACGGTGTGCGTCACCCGGCAACCTTGGGCAGCAGCGAAGTCGAGGCAT<br>TTCTGTCCTGGCTGGCGAACGAGCGCAAGGTTTCGGTCTCCACGCATCGTCAGGCATTGGCGGCCTTGCTGTTCTTCTACGGCAAGGTGCTGTGCACG<br>GATCTGCCCTGGCTTCAGGAGATCGGAAGACCTCGGCCGTCGCGGCGCTTGCCGGTGGTGCTGACCCCGGATGAAGTGGTTCGCATCCTCGGTTTTCT<br>GGAAGGCGAGCATCGTTTGTTCGCCCAGGACTCTAGCTATAGTTCTAGTGGTTGGCTACGTATACTCCGGAATATTAATAGATCATGGAGATAATTAA<br>AATGATAACCATCTCGCAAATAAATAAGTATTTTACTGTTTTCGTAACAGTTTTGTAATAAAAAAACCTATAAATATTCCGGATTATTCATACCGTCC<br>CACCATCGGGCGCGGATCTCGGTCCGAAACCATGTCGTACTACCATCACCATCACCATCACGATTACGATATCCCAACGACCGAAAACCTGTATTTTC<br>AGGGCGCCATGGGATCCGGCCGGCCCCTGCAGGCAGCTGCGCGCTCGCTCGCTCACTGAGGCCGCCCGGGCAAAGCCCGGGCGTCGGGCGACCTTTGG<br>TCGCCCGGCCTCAGTGAGCGAGCGAGCGCGCAGAGAGGGAGTGGCCAACTCCATCACTAGGGGTTCCTTGTAGTTAATGATTAACCCGCCATGCTACT<br>TATCTACGTAGCCATGCTCTAGAGCGGCCGCCCCTAAAATGGGCAAACATTGCAAGCAGCAAACAGCAAACACACAGCCCTCCCTGCCTGCTGACCTT<br>GGAGCTGGGGCAGAGGTCAGAGACCTCTCTGGGCCCATGCCACCTCCAACATCCACTCGACCCCTTGGAATTTTTCGGTGGAGAGGAGCAGAGGTTGT<br>CCTGGCGTGGTTTAGGTAGTGTGAGAGGG**GAATGACTCCTTTCGGTAAGTGCAGTGGAAGCTGTACACTGCCCAGGCAAAGCGTCCGGGCAGCGTAGG**<br>**CGGGCGACTCAGATCCCAGCCAGTGGACTTAGCCCCTGTTTGCTCCTCCGATAACTGGGGTGACCTTGGTTAATATTCACCAGCAGCCTCCCCCGTTG**<br>**CCCCTCTGGATCCACTGCTTAAATACGGACGAGGACAGG**GCCCTGTCTCCTCAGCTTCAGGCACCACCACTGACCTGGGACAGTGAATCCGGACTCTA<br>AGGTAAATATAAAATTTTTAAGTGTATAATGTGTTAAACTACTGATTCTAATTGTTTCTCTCTTTTAGATTCCAACCTTTGGAACTGAGTTTAAACCG<br>CAGCCACCATGCAGATCGAGCTGTCTACCTGCTTCTTCCTGTGCCTGCTGCGGTTCTGCTTCAGCGCCACCAGAAGATATTACCTGGGCGCCGTGGAA<br>CTGAGCTGGGACTACATGCAGTCTGACCTGGGAGAGCTGCCCGTGGACGCTAGATTTCCTCCAAGAGTGCCCAAGAGCTTCCCCTTCAACACCTCCGT<br>GGTGTACAAGAAAACCCTGTTCGTGGAATTCACCGACCACCTGTTCAATATCGCCAAGCCTCGGCCTCCTTGGATGGGACTGCTGGGACCTACAATTC<br>AGGCCGAGGTGTACGACACCGTGGTCATCACCCTGAAGAACATGGCCAGCCATCCTGTGTCTCTGCACGCCGTGGGAGTGTCTTATTGGAAGGCTTCT<br>GAGGGCGCCGAGTACGACGATCAGACAAGCCAGAGAGAGAAAGAGGACGACAAGGTTTTCCCTGGCGGCAGCCACACCTATGTCTGGCAGGTCCTGAA<br>AGAAAACGGCCCTATGGCCTCCGATCCTCTGTGCCTGACATACAGCTACCTGAGCCACGTGGACCTGGTCAAGGACCTGAATTCTGGCCTGATCGGAG<br>CCCTGCTCGTGTGTAGAGAAGGCAGCCTGGCCAAAGAGAAAACCCAGACACTGCACAAGTTCATCCTGCTGTTCGCCGTGTTCGACGAGGGCAAGAGC<br>TGGCACAGCGAGACAAAGAACAGCCTGATGCAGGACAGGGATGCCGCCTCTGCTAGAGCTTGGCCTAAGATGCACACCGTGAACGGCTACGTGAACAG |

TABLE 9-continued

| ceDNA Vector Name | Nucleic Acid Sequence |
|---|---|
| | AAGCCTGCCTGGACTGATCGGCTGCCACAGAAAGTCCGTGTACTGGCACGTGATCGGCATGGGCACAACACCTGAGGTGCACAGCATCTTTCTGGAAG |
| | GCCACACCTTCCTCGTGCGGAACCACAGACAGGCCAGCCTGGAAATCAGCCCTATCACCTTCCTGACCGCTCAGACCCTGCTGATGGATCTGGGCCAG |
| | TTTCTGCTGTTCTGCCACATCAGCTCCCACCAGCACGATGGCATGGAAGCCTACGTGAAGGTGGACAGCTGCCCCGAAGAACCCCAGCTGCGGATGAA |
| | GAACAACGAGGAAGCCGAGGACTACGACGACGACCTGACCGACTCTGAGATGGACGTCGTCAGATTCGACGACGATAACAGCCCCAGCTTCATCCAGA |
| | TCAGAAGCGTGGCCAAGAAGCACCCCAAGACCTGGGTGCACTATATCGCCGCCGAGGAAGAGGACTGGGATTACGCTCCTCTGGTGCTGGCCCCTGAC |
| | GACAGAAGCTACAAGAGCCAGTACCTGAACAACGGCCCTCAGCGGATCGGCCGGAAGTATAAGAAAGTGCGGTTCATGGCCTACACCGACGAGACATT |
| | CAAGACCAGAGAGGCCATCCAGCACGAGAGCGGAATTCTGGGCCCTCTGCTGTATGGCGAAGTGGGCGATACACTGCTGATCATCTTCAAGAACCAGG |
| | CCAGCAGACCCTACAACATCTACCCTCACGGCATCACCGATGTGCGGCCCCTGTATTCTAGAAGGCTGCCCAAGGGCGTGAAGCACCTGAAGGACTTC |
| | CCTATCCTGCCTGGCGAGATTTTCAAGTACAAGTGGACCGTGACCGTGGAAGATGGCCCCACCAAGAGCGACCCTAGATGTCTGACACGGTACTACAG |
| | CAGCTTCGTGAACATGGAACGCGACCTGGCCAGCGGCCTGATTGGACCTCTGCTGATCTGCTACAAAGAAAGCGTGGACCAGCGGGGCAACCAGATCA |
| | TGAGCGACAAGCGGAACGTGATCCTGTTTAGCGTGTTCGATGAGAACCGGTCCTGGTATCTGACCGAGAACATCCAGCGGTTTCTGCCCAATCCTGCC |
| | GGGGTGCAACTGGAAGATCCTGAGTTCCAGGCAAGCAACATCATGCACTCCATCAATGGCTATGTGTTCGACAGCCTGCAGCTGAGCGTGTGCCTGCA |
| | CGAAGTGGCCTACTGGTACATCCTGAGCATTGGCGCCCAGACCGACTTCCTGTCCGTGTTCTTTAGCGGCTACACCTTCAAGCACAAGATGGTGTACG |
| | AGGATACCCTGACACTGTTCCCATTCAGCGGCGAGACAGTGTTCATGAGCATGGAAAACCCCGGCCTGTGGATTCTGGGCTGTCACAACAGCGACTTC |
| | CGGAACAGAGGCATGACAGCCCTGCTGAAGGTGTCCAGCTGCGACAAGAACACCGGCGACTACTACGAGGACAGCTATGAGGACATCAGCGCCTACCT |
| | GCTGAGCAAGAACAATGCCATCGAGCCCAGAAGCTTCAGCCAGAATAGCAGACACCCCTCCACCAGACAGAAGCAGTTCAACGCCACAACAATCCCCG |
| | AGAACGACATCGAGAAAACCGATCCTTGGTTTGCCCACAGAACCCCTATGCCTAAGATCCAGAACGTGTCCTCCAGCGATCTGCTGATGCTCCTGAGA |
| | CAGAGCCCTACACCTCACGGACTGAGCCTGTCCGATCTGCAAGAGGCCAAATACGAAACCTTCAGCGACGACCCTTCTCCTGGCGCCATCGACAGCAA |
| | CAATAGCCTGAGCGAGATGACCCACTTCAGACCACAGCTGCACCACAGCGGCGACATGGTGTTTACACCTGAGAGCGGCCTCCAGCTGAGACTGAATG |
| | AGAAGCTGGGAACCACCGCCGCCACCGAGCTGAAGAAACTGGACTTCAAGGTGTCCTCTACCAGCAACAACCTGATCAGCACAATCCCCTCCGACAAC |
| | CTGGCTGCCGGCACCGACAACACATCTTCTCTGGGCCCACCTAGCATGCCCGTGCACTACGATAGCCAGCTGGATACCACACTGTTCGGCAAGAAGTC |
| | TAGCCCTCTGACAGAGTCTGGCGGCCCTCTGTCTCTGAGCGAGGAAAACAACGACAGCAAGCTGCCTCCTGTGCTGAAGCGGCACCAGCGGGAAATCA |
| | CCAGAACCACACTGCAGAGCGACCAAGAGGAAATCGATTACGACGACACCATCAGCGTCGAGATGAAGAAAGAAGATTTCGACATCTACGACGAGGAC |
| | GAGAATCAGAGCCCCAGATCCTTTCAGAAAAAGACCCGGCACTACTTCATTGCCGCCGTCGAGAGACTGTGGGACTACGGCATGTCTAGCAGCCCTCA |
| | CGTGCTGAGAAATAGAGCCCAGAGCGGCAGCGTGCCCCAGTTCAAGAAAGTGGTGTTCCAAGAGTTCACCGACGGCAGCTTCACCCAGCCACTGTATA |
| | GAGGCGAGCTGAACGAGCATCTGGGCCTGCTGGGCCCTTATATCAGAGCCGAAGTGGAAGATAACATCATGGTCACCTTCCGGAATCAGGCTAGCCGG |
| | CCTTACAGCTTCTACAGCTCCCTGATCTCCTACGAAGAGGACCAGAGACAGGGCGCTGAGCCCCGGAAGAATTTCGTGAAGCCCAACGAGACTAAGAC |
| | CTACTTTTGGAAGGTGCAGCACCACATGGCCCCTACAAAGGACGAGTTCGACTGCAAAGCCTGGGCCTACTTCTCCGATGTGGATCTGGAAAAGGACG |
| | TGCACAGCGGGCTCATCGGACCACTGCTTGTGTGCCACACCAACACACTGAACCCCGCTCACGGCAGACAAGTGACAGTGCAAGAGTTCGCCCTGTTC |
| | TTCACCATCTTCGACGAAACAAAGAGCTGGTACTTCACCGAGAATATGGAACGGAACTGCAGGGCCCCTTGCAACATCCAGATGGAAGATCCCACCTT |
| | CAAAGAGAACTACCGGTTCCACGCCATCAACGGCTACATCATGGACACACTGCCCGGCCTGGTTATGGCCCAGGATCAGAGAATCCGGTGGTATCTGC |
| | TGTCCATGGGCTCCAACGAGAATATCCACAGCATCCACTTCAGCGGCCACGTGTTCACCGTGCGGAAAAAAGAAGAGTACAAAATGGCCCTGTACAAT |
| | CTGTACCCTGGGGTGTTCGAAACCGTGGAAATGCTGCCTTCCAAGGCCGGCATTTGGAGAGTGGAATGTCTGATTGGAGAGCACCTCCACGCCGGAAT |
| | GAGCACCCTGTTTCTGGTGTACTCCAACAAGTGTCAGACCCCTCTCGGCATGGCCTCTGGACACATCAGAGACTTCCAGATCACCGCCTCTGGCCAGT |
| | ACGGACAGTGGGCTCCTAAACTGGCTCGGCTGCACTACTCCGGCAGCATCAATGCCTGGTCCACCAAAGAGCCCTTCAGCTGGATCAAGGTGGACCTG |
| | CTGGCTCCCATGATCATCCACGGAATCAAGACCCAGGGCGCAAGACAGAAGTTCAGCAGCCTGTACATCAGCCAGTTCATCATCATGTACAGCCTGGA |
| | CGGAAAGAAGTGGCAGACCTACCGGGGCAATAGCACCGGCACACTCATGGTGTTCTTCGGCAACGTGGACTCCAGCGGCATTAAGCACAACATCTTCA |
| | ACCCTCCAATCATTGCCCGGTACATCCGGCTGCACCCCACACACTACAGCATCCGGTCTACCCTGAGAATGGAACTGATGGGCTGCGACCTGAACAGC |
| | TGCTCTATGCCCCTCGGAATGGAAAGCAAGGCCATCAGCGACGCCCAGATCACAGCCAGCAGCTACTTCACCAACATGTTCGCCACTTGGAGCCCCTC |
| | CAAGGCTAGACTGCATCTGCAGGGCAGAAGCAACGCTTGGAGGCCCCAAGTGAACAACCCCAAAGAGTGGCTGCAGGTTGACTTTCAAAAGACCATGA |
| | AAGTGACCGGCGTGACCACACAGGGCGTCAAGTCTCTGCTGACCTCTATGTACGTGAAAGAGTTCCTGATTAGCAGCAGCCAGGACGGCCACCAGTGG |
| | ACCCTGTTTTTCCAGAACGGCAAAGTGAAAGTGTTCCAGGGCAATCAGGACAGCTTCACACCCGTGGTCAATTCTCTGGACCCTCCACTGCTGACCAG |
| | ATACCTGCGGATTCACCCTCAGTCTTGGGTGCACCAGATCGCTCTGCGGATGGAAGTGCTGGGCTGTGAAGCTCAGGACCTCTACTAGTTAATTAAGA |
| | GCATCTTACCGCCATTTATTCCCATATTTGTTCTGTTTTTCTTGATTTGGGTATACATTTAAATGTTAATAAAACAAAATGGTGGGGCAATCATTTAC |
| | ATTTTTAGGGATATGTAATTACTAGTTCAGGTGTATTGCCACAAGACAAACATGTTAAGAAACTTTCCCGTTATTTACGCTCTGTTCCTGTTAATCAA |
| | CCTCTGGATTACAAAATTTGTGAAAGATTGACTGATATTCTTAACTATGTTGCTCCTTTTACGCTGTGTGGATATGCTGCTTTATAGCCTCTGTATCT |
| | AGCTATTGCTTCCCGTACGGCTTTCGTTTTCTCCTCCTTGTATAAATCCTGGTTGCTGTCTCTTTTAGAGGAGTTGTGGCCCGTTGTCCGTCAACGTG |
| | GCGTGGTGTGCTCTGTGTTTGCTGACGCAACCCCCACTGGCTGGGGCATTGCCACCACCTGTCAACTCCTTTCTGGGACTTTCGCTTTCCCCCTCCCG |
| | ATCGCCACGGCAGAACTCATCGCCGCCTGCCTTGCCCGCTGCTGGACAGGGGCTAGGTTGCTGGGCACTGATAATTCCGTGGTGTTGTCTGTGCCTTC |
| | TAGTTGCCAGCCATCTGTTGTTTGCCCCTCCCCCGTGCCTTCCTTGACCCTGGAAGGTGCCACTCCCACTGTCCTTTCCTAATAAAATGAGGAAATTG |

TABLE 9-continued

| ceDNA Vector Name | Nucleic Acid Sequence |
|---|---|
| | CATCGCATTGTCTGAGTAGGTGTCATTCTATTCTGGGGGGTGGGGTGGGGCAGGACAGCAAGGGGGAGGATTGGGAAGACAATAGCAGGCATGCTGGG |
| | GATGCGGTGGGCTCTATGGCTCTAGAGCATGGCTACGTAGATAAGTAGCATGGCGGGTTAATCATTAACTACACCTGCAGGAGGAACCCCTAGTGATG |
| | GAGTTGGCCACTCCCTCTCTGCGCGCTCGCTCGCTCACTGAGGCCGGGCGACCAAAGGTCGCCCGACGCCCGGGCGGCCTCAGTGAGCGAGCGAGCGC |
| | GCAGCTGCCTGCAGGGGCGCGCCTCGAGGCATGCGGTACCAAGCTTGTCGAGAAGTACTAGAGGATCATAATCAGCCATACCACATTTGTAGAGGTTT |
| | TACTTGCTTTAAAAAACCTCCCACACCTCCCCCTGAACCTGAAACATAAAATGAATGCAATTGTTGTTGTTAACTTGTTTATTGCAGCTTATAATGGT |
| | TACAAATAAAGCAATAGCATCACAAATTTCACAAATAAAGCATTTTTTTCACTGCATTCTAGTTGTGGTTTGTCCAAACTCATCAATGTATCTTATCA |
| | TGTCTGGATCTGATCACTGATATCGCCTAGGAGATCCGAACCAGATAAGTGAAATCTAGTTCCAAACTATTTTGTCATTTTTAATTTTCGTATTAGCT |
| | TACGACGCTACACCCAGTTCCCATCTATTTTGTCACTCTTCCCTAAATAATCCTTAAAAACTCCATTTCCACCCCTCCCAGTTCCCAACTATTTTGTC |
| | CGCCCACAGCGGGGCATTTTTCTTCCTGTTATGTTTTTAATCAAACATCCTGCCAACTCCATGTGACAAACCGTCATCTTCGGCTACTTTTTCTCTGT |
| | CACAGAATGAAAATTTTTCTGTCATCTCTTCGTTATTAATGTTTGTAATTGACTGAATATCAACGCTTATTTGCAGCCTGAATGGCGAATGG |
| ceDNAFVIII-vector 8 (SEQ ID NO: 199) | GACGCGCCCTGTAGCGGCGCATTAAGCGCGGCGGGTGTGGTGGTTACGCGCAGCGTGACCGCTACACTTGCCAGCGCCCTAGCGCCCGCTCCTTTCGC |
| | TTTCTTCCCTTCCTTTCTCGCCACGTTCGCCGGCTTTCCCCGTCAAGCTCTAAATCGGGGGCTCCCTTTAGGGTTCCGATTTAGTGCTTTACGGCACC |
| | TCGACCCCAAAAAACTTGATTAGGGTGATGGTTCACGTAGTGGGCCATCGCCCTGATAGACGGTTTTTCGCCCTTTGACGTTGGAGTCCACGTTCTTT |
| | AATAGTGGACTCTTGTTCCAAACTGGAACAACACTCAACCCTATCTCGGTCTATTCTTTTGATTTATAAGGGATTTTGCCGATTTCGGCCTATTGGTT |
| | AAAAAATGAGCTGATTTAACAAAAATTTAACGCGAATTTTAACAAAATATTAACGTTTACAATTTCAGGTGGCACTTTTCGGGGAAATGTGCGCGGAA |
| | CCCCTATTTGTTTATTTTTCTAAATACATTCAAATATGTATCCGCTCATGAGACAATAACCCTGATAAATGCTTCAATAATATTGAAAAAGGAAGAGT |
| | ATGAGTATTCAACATTTCCGTGTCGCCCTTATTCCCTTTTTTGCGGCATTTTGCCTTCCTGTTTTTGCTCACCCAGAAACGCTGGTGAAAGTAAAAGA |
| | TGCTGAAGATCAGTTGGGTGCACGAGTGGGTTACATCGAACTGGATCTCAACAGCGGTAAGATCCTTGAGAGTTTTCGCCCCGAAGAACGTTTTCCAA |
| | TGATGAGCACTTTTAAAGTTCTGCTATGTGGCGCGGTATTATCCCGTATTGACGCCGGGCAAGAGCAACTCGGTCGCCGCATACACTATTCTCAGAAT |
| | GACTTGGTTGAGTACTCACCAGTCACAGAAAAGCATCTTACGGATGGCATGACAGTAAGAGAATTATGCAGTGCTGCCATAACCATGAGTGATAACAC |
| | TGCGGCCAACTTACTTCTGACAACGATCGGAGGACCGAAGGAGCTAACCGCTTTTTTGCACAACATGGGGGATCATGTAACTCGCCTTGATCGTTGGG |
| | AACCGGAGCTGAATGAAGCCATACCAAACGACGAGCGTGACACCACGATGCCTGTAGCAATGGCAACAACGTTGCGCAAACTATTAACTGGCGAACTA |
| | CTTACTCTAGCTTCCCGGCAACAATTAATAGACTGGATGGAGGCGGATAAAGTTGCAGGACCACTTCTGCGCTCGGCCCTTCCGGCTGGCTGGTTTAT |
| | TGCTGATAAATCTGGAGCCGGTGAGCGTGGGTCTCGCGGTATCATTGCAGCACTGGGGCCAGATGGTAAGCCCTCCCGTATCGTAGTTATCTACACGA |
| | CGGGGAGTCAGGCAACTATGGATGAACGAAATAGACAGATCGCTGAGATAGGTGCCTCACTGATTAAGCATTGGTAACTGTCAGACCAAGTTTACTCA |
| | TATATACTTTAGATTGATTTAAAACTTCATTTTTAATTTAAAAGGATCTAGGTGAAGATCCTTTTTGATAATCTCATGACCAAAATCCCTTAACGTGA |
| | GTTTTCGTTCCACTGAGCGTCAGACCCCGTAGAAAAGATCAAAGGATCTTCTTGAGATCCTTTTTTTCTGCGCGTAATCTGCTGCTTGCAAACAAAAA |
| | AACCACCGCTACCAGCGGTGGTTTGTTTGCCGGATCAAGAGCTACCAACTCTTTTTCCGAAGGTAACTGGCTTCAGCAGAGCGCAGATACCAAATACT |
| | GTCCTTCTAGTGTAGCCGTAGTTAGGCCACCACTTCAAGAACTCTGTAGCACCGCCTACATACCTCGCTCTGCTAATCCTGTTACCAGTGGCTGCTGC |
| | CAGTGGCGATAAGTCGTGTCTTACCGGGTTGGACTCAAGACGATAGTTACCGGATAAGGCGCAGCGGTCGGGCTGAACGGGGGGTTCGTGCACACAGC |
| | CCAGCTTGGAGCGAACGACCTACACCGAACTGAGATACCTACAGCGTGAGCATTGAGAAAGCGCCACGCTTCCCGAAGGGAGAAAGGCGGACAGGTAT |
| | CCGGTAAGCGGCAGGGTCGGAACAGGAGAGCGCACGAGGGAGCTTCCAGGGGGAAACGCCTGGTATCTTTATAGTCCTGTCGGGTTTCGCCACCTCTG |
| | ACTTGAGCGTCGATTTTTGTGATGCTCGTCAGGGGGGCGGAGCCTATGGAAAAACGCCAGCAACGCGGCCTTTTTACGGTTCCTGGCCTTTTGCTGGC |
| | CTTTTGCTCACATGTTCTTTCCTGCGTTATCCCCTGATTCTGTGGATAACCGTATTACCGCCTTTGAGTGAGCTGATACCGCTCGCCGCAGCCGAACG |
| | ACCGAGCGCAGCGAGTCAGTGAGCGAGGAAGCGGAAGAGCGCCTGATGCGGTATTTTCTCCTTACGCATCTGTGCGGTATTTCACACCGCAGACCAGC |
| | CGCGTAACCTGGCAAAATCGGTTACGGTTGAGTAATAAATGGATGCCCTGCGTAAGCGGGTGTGGGCGGACAATAAAGTCTTAAACTGAACAAAATAG |
| | ATCTAAACTATGACAATAAAGTCTTAAACTAGACAGAATAGTTGTAAACTGAAATCAGTCCAGTTATGCTGTGAAAAAGCATACTGGACTTTTGTTAT |
| | GGCTAAAGCAAACTCTTCATTTTCTGAAGTGCAAATTGCCCGTCGTATTAAAGAGGGGCGTGGCCAAGGGCATGGTAAAGACTATATTCGCGGCGTTG |
| | TGACAATTTACCGAACAACTCCGCGGCCGGGAAGCCGATCTCGGCTTGAACGAATTGTTAGGTGGCGGTACTTGGGTCGATATCAAAGTGCATCACTT |
| | CTTCCCGTATGCCCAACTTTGTATAGAGAGCCACTGCGGGATCGTCACCGTAATCTGCTTGCACGTAGATCACATAAGCACCAAGCGCGTTGGCCTCA |
| | TGCTTGAGGAGATTGATGAGCGCGGTGGCAATGCCCTGCCTCCGGTGCTCGCCGGAGACTGCGAGATCATAGATATAGATCTCACTACGCGGCTGCTC |
| | AAACCTGGGCAGAACGTAAGCCGCGAGAGCGCCAACAACCGCTTCTTGGTCGAAGGCAGCAAGCGCGATGAATGTCTTACTACGGAGCAAGTTCCCGA |
| | GGTAATCGGAGTCCGGCTGATGTTGGGAGTAGGTGGCTACGTCTCCGAACTCACGACCGAAAAGATCAAGAGCAGCCCGCATGGATTTGACTTGGTCA |
| | GGGCCGAGCCTACATGTGCGAATGATGCCCATACTTGAGCCACCTAACTTTGTTTTAGGGCGACTGCCCTGCTGCGTAACATCGTTGCTGCTGCGTAA |
| | CATCGTTGCTGCTCCATAACATCAAACATCGACCCACGGCGTAACGCGCTTGCTGCTTGGATGCCCGAGGCATAGACTGTACAAAAAAACAGTCATAA |
| | CAAGCCATGAAAACCGCCACTGCGCCGTTACCACCGCTGCGTTCGGTCAAGGTTCTGGACCAGTTGCGTGAGCGCATACGCTACTTGCATTACAGTTT |
| | ACGAACCGAACAGGCTTATGTCAACTGGGTTCGTGCCTTCATCCGTTTCCACGGTGTGCGTCACCCGGCAACCTTGGGCAGCAGCGAAGTCGAGGCAT |
| | TTCTGTCCTGGCTGGCGAACGAGCGCAAGGTTTCGGTCTCCACGCATCGTCAGGCATTGGCGGCCTTGCTGTTCTTCTACGGCAAGGTGCTGTGCACG |
| | GATCTGCCCTGGCTTCAGGAGATCGGAAGACCTCGGCCGTCGCGGCGCTTGCCGGTGGTGCTGACCCCGGATGAAGTGGTTCGCATCCTCGGTTTTCT |

TABLE 9-continued

| ceDNA Vector Name | Nucleic Acid Sequence |
| --- | --- |
| | GGAAGGCGAGCATCGTTTGTTCGCCCAGGACTCTAGCTATAGTTCTAGTGGTTGGCTACGTATACTCCGGAATATTAATAGATCATGGAGATAATTAA |
| | AATGATAACCATCTCGCAAATAAATAAGTATTTTACTGTTTTCGTAACAGTTTTGTAATAAAAAAACCTATAAATATTCCGGATTATTCATACCGTCC |
| | CACCATCGGGCGCGGATCTCGGTCCGAAACCATGTCGTACTACCATCACCATCACCATCACGATTACGATATCCCAACGACCGAAAACCTGTATTTTC |
| | AGGGCGCCATGGGATCCGGCCGGCCCCTGCAGGCAGCTGCGCGCTCGCTCGCTCACTGAGGCCGCCCGGGCAAAGCCCGGGCGTCGGGCGACCTTTGG |
| | TCGCCCGGCCTCAGTGAGCGAGCGAGCGCGCAGAGAGGGAGTGGCCAACTCCATCACTAGGGGTTCCTTGTAGTTAATGATTAACCCGCCATGCTACT |
| | TATCTACGTAGCCATGCTCTAGAGCGGCCGC**GGCTCCGGTGCCCGTCAGTGGGCAGAGCGCACATCGCCCACAGTCCCCGAGAAGTTGGGGGGAGGGG** |
| | **TCGGCAATTGAACCGGTGCCTAGAGAAGGTGGCGCGGGGTAAACTGGGAAAGTGATGTCGTGTACTGGCTCCGCCTTTTTCCCGAGGGTGGGGGAGAA** |
| | **CCGTATATAAGTGCAGTAGTCGCCGTGAACGTTCTTTTTCGCAACGGGTTTGCCGCCAGAACACAGGTAAGTGCCGTGTGTGGTTCCCGC**GGGCCTGG |
| | CCTCTTTACGGGTTATGGCCCTTGCGTGCCTTGAATTACTTCCACCTGGCTGCAGTACGTGATTCTTGATCCCGAGCTTCGGGTTGGAAGTGGGTGGG |
| | AGAGTTCGAGGCCTTGCGCTTAAGGAGCCCCTTCGCCTCGTGCTTGAGTTGAGGCCTGGCCTGGGCGCTGGGGCCGCCGCGTGCGAATCTGGTGGCAC |
| | CTTCGCGCCTGTCTCGCTGCTTTCGATAAGTCTCTAGCCATTTAAAATTTTTGATGACCTGCTGCGACGCTTTTTTTCTGGCAAGATAGTCTTGTAAA |
| | TGCGGGCCAAGATCTGCACACTGGTATTTCGGTTTTTGGGGCCGCGGGCGGCGACGGGGCCCGTGCGTCCCAGCGCACATGTTCGGCGAGGCGGGGCC |
| | TGCGAGCGCGGCCACCGAGAATCGGACGGGGGTAGTCTCAAGCTGGCCGGCCTGCTCTGGTGCCTGGTCTCGCGCCGCCGTGTATCGCCCCGCCCTGG |
| | GCGGCAAGGCTGGCCCGGTCGGCACCAGTTGCGTGAGCGGAAAGATGGCCGCTTCCCGGCCCTGCTGCAGGGAGCTCAAAATGGAGGACGCGGCGCTC |
| | GGGAGAGCGGGCGGGTGAGTCACCCACACAAAGGAAAAGGGCCTTTCCGTCCTCAGCCGTCGCTTCATGTGACTCCACGGAGTACCGGGCGCCGTCCA |
| | GGCACCTCGATTAGTTCTCGAGCTTTTGGAGTACGTCGTCTTTAGGTTGGGGGGAGGGGTTTTATGCGATGGAGTTTCCCCACACTGAGTGGGTGGAG |
| | ACTGAAGTTAGGCCAGCTTGGCACTTGATGTAATTCTCCTTGGAATTTGCCCTTTTTGAGTTTGGATCTTGGTTCATTCTCAAGCCTCAGACAGTGGT |
| | TCAAAGTTTTTTTCTTCCATTTCAGGTGTCGTGAGTTTAAACCGCAGCCACCATGCAGATCGAGCTGTCTACCTGCTTCTTCCTGTGCCTGCTGCGGT |
| | TCTGCTTCAGCGCCACCAGAAGATATTACCTGGGCGCCGTGGAACTGAGCTGGGACTACATGCAGTCTGACCTGGGAGAGCTGCCCGTGGACGCTAGA |
| | TTTCCTCCAAGAGTGCCCAAGAGCTTCCCCTTCAACACCTCCGTGGTGTACAAGAAAACCCTGTTCGTGGAATTCACCGACCACCTGTTCAATATCGC |
| | CAAGCCTCGGCCTCCTTGGATGGGACTGCTGGGACCTACAATTCAGGCCGAGGTGTACGACACCGTGGTCATCACCCTGAAGAACATGGCCAGCCATC |
| | CTGTGTCTCTGCACGCCGTGGGAGTGTCTTATTGGAAGGCTTCTGAGGGCGCCGAGTACGACGATCAGACAAGCCAGAGAGAGAAAGAGGACGACAAG |
| | GTTTTCCCTGGCGGCAGCCACACCTATGTCTGGCAGGTCCTGAAAGAAAACGGCCCTATGGCCTCCGATCCTCTGTGCCTGACATACAGCTACCTGAG |
| | CCACGTGGACCTGGTCAAGGACCTGAATTCTGGCCTGATCGGAGCCCTGCTCGTGTGTAGAGAAGGCAGCCTGGCCAAAGAGAAAACCCAGACACTGC |
| | ACAAGTTCATCCTGCTGTTCGCCGTGTTCGACGAGGGCAAGAGCTGGCACAGCGAGACAAAGAACAGCCTGATGCAGGACAGGGATGCCGCCTCTGCT |
| | AGAGCTTGGCCTAAGATGCACACCGTGAACGGCTACGTGAACAGAAGCCTGCCTGGACTGATCGGCTGCCACAGAAAGTCCGTGTACTGGCACGTGAT |
| | CGGCATGGGCACAACACCTGAGGTGCACAGCATCTTTCTGGAAGGCCACACCTTCCTCGTGCGGAACCACAGACAGGCCAGCCTGGAAATCAGCCCTA |
| | TCACCTTCCTGACCGCTCAGACCCTGCTGATGGATCTGGGCCAGTTTCTGCTGTTCTGCCACATCAGCTCCCACCAGCACGATGGCATGGAAGCCTAC |
| | GTGAAGGTGGACAGCTGCCCCGAAGAACCCCAGCTGCGGATGAAGAACAACGAGGAAGCCGAGGACTACGACGACGACCTGACCGACTCTGAGATGGA |
| | CGTCGTCAGATTCGACGACGATAACAGCCCCAGCTTCATCCAGATCAGAAGCGTGGCCAAGAAGCACCCCAAGACCTGGGTGCACTATATCGCCGCCG |
| | AGGAAGAGGACTGGGATTACGCTCCTCTGGTGCTGGCCCCTGACGACAGAAGCTACAAGAGCCAGTACCTGAACAACGGCCCTCAGCGGATCGGCCGG |
| | AAGTATAAGAAAGTGCGGTTCATGGCCTACACCGACGAGACATTCAAGACCAGAGAGGCCATCCAGCACGAGAGCGGAATTCTGGGCCCTCTGCTGTA |
| | TGGCGAAGTGGGCGATACACTGCTGATCATCTTCAAGAACCAGGCCAGCAGACCCTACAACATCTACCCTCACGGCATCACCGATGTGCGGCCCCTGT |
| | ATTCTAGAAGGCTGCCCAAGGGCGTGAAGCACCTGAAGGACTTCCCTATCCTGCCTGGCGAGATTTTCAAGTACAAGTGGACCGTGACCGTGGAAGAT |
| | GGCCCCACCAAGAGCGACCCTAGATGTCTGACACGGTACTACAGCAGCTTCGTGAACATGGAACGCGACCTGGCCAGCGGCCTGATTGGACCTCTGCT |
| | GATCTGCTACAAAGAAAGCGTGGACCAGCGGGGCAACCAGATCATGAGCGACAAGCGGAACGTGATCCTGTTTAGCGTGTTCGATGAGAACCGGTCCT |
| | GGTATCTGACCGAGAACATCCAGCGGTTTCTGCCCAATCCTGCCGGGGTGCAACTGGAAGATCCTGAGTTCCAGGCAAGCAACATCATGCACTCCATC |
| | AATGGCTATGTGTTCGACAGCCTGCAGCTGAGCGTGTGCCTGCACGAAGTGGCCTACTGGTACATCCTGAGCATTGGCGCCCAGACCGACTTCCTGTC |
| | CGTGTTCTTTAGCGGCTACACCTTCAAGCACAAGATGGTGTACGAGGATACCCTGACACTGTTCCCATTCAGCGGCGAGACAGTGTTCATGAGCATGG |
| | AAAACCCCGGCCTGTGGATTCTGGGCTGTCACAACAGCGACTTCCGGAACAGAGGCATGACAGCCCTGCTGAAGGTGTCCAGCTGCGACAAGAACACC |
| | GGCGACTACTACGAGGACAGCTATGAGGACATCAGCGCCTACCTGCTGAGCAAGAACAATGCCATCGAGCCCAGAAGCTTCAGCCAGAATAGCAGACA |
| | CCCCTCCACCAGACAGAAGCAGTTCAACGCCACAACAATCCCCGAGAACGACATCGAGAAAACCGATCCTTGGTTTGCCCACAGAACCCCTATGCCTA |
| | AGATCCAGAACGTGTCCTCCAGCGATCTGCTGATGCTCCTGAGACAGAGCCCTACACCTCACGGACTGAGCCTGTCCGATCTGCAAGAGGCCAAATAC |
| | GAAACCTTCAGCGACGACCCTTCTCCTGGCGCCATCGACAGCAACAATAGCCTGAGCGAGATGACCCACTTCAGACCACAGCTGCACCACAGCGGCGA |
| | CATGGTGTTTACACCTGAGAGCGGCCTCCAGCTGAGACTGAATGAGAAGCTGGGAACCACCGCCGCCACCGAGCTGAAGAAACTGGACTTCAAGGTGT |
| | CCTCTACCAGCAACAACCTGATCAGCACAATCCCCTCCGACAACCTGGCTGCCGGCACCGACAACACATCTTCTCTGGGCCCACCTAGCATGCCCGTG |
| | CACTACGATAGCCAGCTGGATACCACACTGTTCGGCAAGAAGTCTAGCCCTCTGACAGAGTCTGGCGGCCCTCTGTCTCTGAGCGAGGAAAACAACGA |
| | CAGCAAGCTGCCTCCTGTGCTGAAGCGGCACCAGCGGGAAATCACCAGAACCACACTGCAGAGCGACCAAGAGGAAATCGATTACGACGACACCATCA |
| | GCGTCGAGATGAAGAAAGAAGATTTCGACATCTACGACGAGGACGAGAATCAGAGCCCCAGATCCTTTCAGAAAAAGACCCGGCACTACTTCATTGCC |
| | GCCGTCGAGAGACTGTGGGACTACGGCATGTCTAGCAGCCCTCACGTGCTGAGAAATAGAGCCCAGAGCGGCAGCGTGCCCCAGTTCAAGAAAGTGGT |

TABLE 9-continued

| ceDNA Vector Name | Nucleic Acid Sequence |
|---|---|
| | GTTCCAAGAGTTCACCGACGGCAGCTTCACCCAGCCACTGTATAGAGGCGAGCTGAACGAGCATCTGGGCCTGCTGGGCCCTTATATCAGAGCCGAAG<br>TGGAAGATAACATCATGGTCACCTTCCGGAATCAGGCTAGCCGGCCTTACAGCTTCTACAGCTCCCTGATCTCCTACGAAGAGGACCAGAGACAGGGC<br>GCTGAGCCCCGGAAGAATTTCGTGAAGCCCAACGAGACTAAGACCTACTTTTGGAAGGTGCAGCACCACATGGCCCCTACAAAGGACGAGTTCGACTG<br>CAAAGCCTGGGCCTACTTCTCCGATGTGGATCTGGAAAAGGACGTGCACAGCGGGCTCATCGGACCACTGCTTGTGTGCCACACCAACACACTGAACC<br>CCGCTCACGGCAGACAAGTGACAGTGCAAGAGTTCGCCCTGTTCTTCACCATCTTCGACGAAACAAAGAGCTGGTACTTCACCGAGAATATGGAACGG<br>AACTGCAGGGCCCCTTGCAACATCCAGATGGAAGATCCCACCTTCAAAGAGAACTACCGGTTCCACGCCATCAACGGCTACATCATGGACACACTGCC<br>CGGCCTGGTTATGGCCCAGGATCAGAGAATCCGGTGGTATCTGCTGTCCATGGGCTCCAACGAGAATATCCACAGCATCCACTTCAGCGGCCACGTGT<br>TCACCGTGCGGAAAAAAGAAGAGTACAAAATGGCCCTGTACAATCTGTACCCTGGGGTGTTCGAAACCGTGGAAATGCTGCCTTCCAAGGCCGGCATT<br>TGGAGAGTGGAATGTCTGATTGGAGAGCACCTCCACGCCGGAATGAGCACCCTGTTTCTGGTGTACTCCAACAAGTGTCAGACCCCTCTCGGCATGGC<br>CTCTGGACACATCAGAGACTTCCAGATCACCGCCTCTGGCCAGTACGGACAGTGGGCTCCTAAACTGGCTCGGCTGCACTACTCCGGCAGCATCAATG<br>CCTGGTCCACCAAAGAGCCCTTCAGCTGGATCAAGGTGGACCTGCTGGCTCCCATGATCATCCACGGAATCAAGACCCAGGGCGCAAGACAGAAGTTC<br>AGCAGCCTGTACATCAGCCAGTTCATCATCATGTACAGCCTGGACGGAAAGAAGTGGCAGACCTACCGGGGCAATAGCACCGGCACACTCATGGTGTT<br>CTTCGGCAACGTGGACTCCAGCGGCATTAAGCACAACATCTTCAACCCTCCAATCATTGCCCGGTACATCCGGCTGCACCCCACACACTACAGCATCC<br>GGTCTACCCTGAGAATGGAACTGATGGGCTGCGACCTGAACAGCTGCTCTATGCCCCTCGGAATGGAAAGCAAGGCCATCAGCGACGCCCAGATCACA<br>GCCAGCAGCTACTTCACCAACATGTTCGCCACTTGGAGCCCCTCCAAGGCTAGACTGCATCTGCAGGGCAGAAGCAACGCTTGGAGGCCCCAAGTGAA<br>CAACCCCAAAGAGTGGCTGCAGGTTGACTTTCAAAAGACCATGAAAGTGACCGGCGTGACCACACAGGGCGTCAAGTCTCTGCTGACCTCTATGTACG<br>TGAAAGAGTTCCTGATTAGCAGCAGCCAGGACGGCCACCAGTGGACCCTGTTTTTCCAGAACGGCAAAGTGAAAGTGTTCCAGGGCAATCAGGACAGC<br>TTCACACCCGTGGTCAATTCTCTGGACCCTCCACTGCTGACCAGATACCTGCGGATTCACCCTCAGTCTTGGGTGCACCAGATCGCTCTGCGGATGGA<br>AGTGCTGGGCTGTGAAGCTCAGGACCTCTACTAGTTAATTAAGAGCATCTTACCGCCATTTATTCCCATATTTGTTCTGTTTTTCTTGATTTGGGTAT<br>ACATTTAAATGTTAATAAAACAAAATGGTGGGGCAATCATTTACATTTTTAGGGATATGTAATTACTAGTTCAGGTGTATTGCCACAAGACAAACATG<br>TTAAGAAACTTTCCCGTTATTTACGCTCTGTTCCTGTTAATCAACCTCTGGATTACAAAATTTGTGAAAGATTGACTGATATTCTTAACTATGTTGCT<br>CCTTTTACGCTGTGTGGATATGCTGCTTTATAGCCTCTGTATCTAGCTATTGCTTCCCGTACGGCTTTCGTTTTCTCCTCCTTGTATAAATCCTGGTT<br>GCTGTCTCTTTTAGAGGAGTTGTGGCCCGTTGTCCGTCAACGTGGCGTGGTGTGCTCTGTGTTTGCTGACGCAACCCCCACTGGCTGGGGCATTGCCA<br>CCACCTGTCAACTCCTTTCTGGGACTTTCGCTTTCCCCCTCCCGATCGCCACGGCAGAACTCATCGCCGCCTGCCTTGCCCGCTGCTGGACAGGGGCT<br>AGGTTGCTGGGCACTGATAATTCCGTGGTGTTGTCTGTGCCTTCTAGTTGCCAGCCATCTGTTGTTTGCCCCTCCCCCGTGCCTTCCTTGACCCTGGA<br>AGGTGCCACTCCCACTGTCCTTTCCTAATAAAATGAGGAAATTGCATCGCATTGTCTGAGTAGGTGTCATTCTATTCTGGGGGGTGGGGTGGGGCAGG<br>ACAGCAAGGGGGAGGATTGGGAAGACAATAGCAGGCATGCTGGGGATGCGGTGGGCTCTATGGCTCTAGAGCATGGCTACGTAGATAAGTAGCATGGC<br>GGGTTAATCATTAACTACACCTGCAGGAGGAACCCCTAGTGATGGAGTTGGCCACTCCCTCTCTGCGCGCTCGCTCGCTCACTGAGGCCGGGCGACCA<br>AAGGTCGCCCGACGCCCGGGCGGCCTCAGTGAGCGAGCGAGCGCGCAGCTGCCTGCAGGGGCGCGCCTCGAGGCATGCGGTACCAAGCTTGTCGAGAA<br>GTACTAGAGGATCATAATCAGCCATACCACATTTGTAGAGGTTTTACTTGCTTTAAAAAACCTCCCACACCTCCCCCTGAACCTGAAACATAAAATGA<br>ATGCAATTGTTGTTGTTAACTTGTTTATTGCAGCTTATAATGGTTACAAATAAAGCAATAGCATCACAAATTTCACAAATAAAGCATTTTTTTCACTG<br>CATTCTAGTTGTGGTTTGTCCAAACTCATCAATGTATCTTATCATGTCTGGATCTGATCACTGATATCGCCTAGGAGATCCGAACCAGATAAGTGAAA<br>TCTAGTTCCAAACTATTTTGTCATTTTTAATTTTCGTATTAGCTTACGACGCTACACCCAGTTCCCATCTATTTTGTCACTCTTCCCTAAATAATCCT<br>TAAAAACTCCATTTCCACCCCTCCCAGTTCCCAACTATTTTGTCCGCCCACAGCGGGGCATTTTTCTTCCTGTTATGTTTTTAATCAAACATCCTGCC<br>AACTCCATGTGACAAACCGTCATCTTCGGCTACTTTTTCTCTGTCACAGAATGAAAATTTTTCTGTCATCTCTTCGTTATTAATGTTTGTAATTGACT<br>GAATATCAACGCTTATTTGCAGCCTGAATGGCGAATGG |
| ceDNAFVIII-vector 9 (SEQ ID NO: 200) | AAAGTAGCCGAAGATGACGGTTTGTCACATGGAGTTGGCAGGATGTTTGATTAAAAACATAACAGGAAGAAAAATGCCCCGCTGTGGGCGGACAAAAT<br>AGTTGGGAACTGGGAGGGGTGGAAATGGAGTTTTTAAGGATTATTTAGGGAAGAGTGACAAAATAGATGGGAACTGGGTGTAGCGTCGTAAGCTAATA<br>CGAAAATTAAAAATGACAAAATAGTTTGGAACTAGATTTCACTTATCTGGTTCGGATCTCCTAGGCCTGCAGGCAGCTGCGCGCTCGCTCGCTCACTG<br>AGGCCGCCCGGGCAAAGCCCGGGCGTCGGGCGACCTTTGGTCGCCCGGCCTCAGTGAGCGAGCGAGCGCGCAGAGAGGGAGTGGCCAACTCCATCACT<br>AGGGGTTCCTTGTAGTTAATGATTAACCCGCCATGCTACTTATCGCGGCCGCTCAATATTGGCCATTAGCCATATTATTCATTGGTTATATAGCATAA<br>ATCAATATTGGCTATTGGCCATTGCATACGTTGTATCTATATCATAATATGTACATTTATATTGGCTCATGTCCAATATGACCGCCATGTTGGCATTG<br>ATTATTGACTAGTTATTAATAGTAATCAATTACGGGGTCATTAGTTCATAGCCCATATATGGAGTTCCGCGTTACATAACTTACGGTAAATGGCCCGC<br>CTGGCTGACCGCCCAACGACCCCCGCCCATTGACGTCAATAATGACGTATGTTCCCATAGTAACGCCAATAGGGACTTTCCATTGACGTCAATGGGTG<br>GAGTATTTACGGTAAACTGCCCACTTGGCAGTACATCAAGTGTATCATATGCCAAGTCCGCCCCCTATTGACGTCAATGACGGTAAATGGCCCGCCTG<br>GCATTATGCCCAGTACATGACCTTACGGGACTTTCCTACTTGGCAGTACATCTACGTATTAGTCATCGCTATTACCATGG**TCGAGGTGAGCCCCACGT**<br>**TCTGCTTCACTCTCCCCATCTCCCCCCCCTCCCCACCCCCAATTTTGTATTTATTTATTTTTTAATTATTTTGTGCAGCGATGGGGGCGGGGGGGGGG**<br>**GGGGGGCGCGCGCCAGGCGGGGCGGGGCGGGGCGAGGGGCGGGGCGGGGCGAGGCGGAGAGGTGCGGCGGCAGCCAATCAGAGCGGCGCGCTCCGAAA**<br>**GTTTCCTTTTATGGCGAGGCGGCGGCGGCGGCGGCCCTATA**AAAAGCGAAGCGCGCGGCGGGCGGGAGTCGCTGCGACGCTGCCTTCGCCCCGTGCCC |

TABLE 9-continued

| ceDNA Vector Name | Nucleic Acid Sequence |
|---|---|
| | CGCTCCGCCGCCGCCTCGCGCCGCCCGCCCCGGCTCTGACTGACCGCGTTACTCCCACAGGTGAGCGGGCGGGACGGCCCTTCTCCTCCGGGCTGTAA |
| | TTAGCGCTTGGTTTAATGACGGCTTGTTTCTTTTCTGTGGCTGCGTGAAAGCCTTGAGGGGCTCCGGGAGGGCCCTTTGTGCGGGGGGGAGCGGCTCG |
| | GGGGGTGCGTGCGTGTGTGTGTGCGTGGGGAGCGCCGCGTGCGGCCCGCGCTGCCCGGCGGCTGTGAGCGCTGCGGGCGCGGCGCGGGGCTTTGTGCG |
| | CTCCGCAGTGTGCGCGAGGGGAGCGCGGCCGGGGGCGGTGCCCCGCGGTGCGGGGGGGGCTGCGAGGGGAACAAAGGCTGCGTGCGGGGTGTGTGCGT |
| | GGGGGGGTGAGCAGGGGGTGTGGGCGCGGCGGTCGGGCTGTAACCCCCCCCTGCACCCCCCTCCCCGAGTTGCTGAGCACGGCCCGGCTTCGGGTGCG |
| | GGGCTCCGTACGGGGCGTGGCGCGGGGCTCGCCGTGCCGGGCGGGGGGTGGCGGCAGGTGGGGGTGCCGGGCGGGGCGGGGCCGCCTCGGGCCGGGGA |
| | GGGCTCGGGGGAGGGGCGCGGCGGCCCCCGGAGCGCCGGCGGCTGTCGAGGCGCGGCGAGCCGCAGCCATTGCCTTTTATGGTAATCGTGCGAGAGGG |
| | CGCAGGGACTTCCTTTGTCCCAAATCTGTGCGGAGCCGAAATCTGGGAGGCGCCGCCGCACCCCCTCTAGCGGGCGCGGGGCGAAGCGGTGCGGCGCC |
| | GGCAGGAAGGAAATGGGCGGGGAGGGCCTTCGTGCGTCGCCGCGCCGCCGTCCCCTTCTCCCTCTCCAGCCTCGGGGCTGTCCGCGGGGGGACGGCTG |
| | CCTTTCGGGGGGGACGGGGCAGGGCGGGGTTCGGCTTCTGGCGTGTGACCGGCGGCTCTAGAGCCTCTGCTAACCATGTTTTAGCCTTTCTTCTTTTT |
| | CCTACAGCTCCTGGGCAACGTGCTGGTTATTGTGCTGTCTCATCATTTGTCGACAGAATTCCTCGAAGATCCGAAGGGGTTCAAGCTTGGCATTCCGG |
| | TACTGTTGGTAAAGCCAGTTTAAACCGCAGCCACCATGCAGATCGAGCTGTCTACCTGCTTCTTCCTGTGCCTGCTGCGGTTCTGCTTCAGCGCCACC |
| | AGAAGATATTACCTGGGCGCCGTGGAACTGAGCTGGGACTACATGCAGTCTGACCTGGGAGAGCTGCCCGTGGACGCTAGATTTCCTCCAAGAGTGCC |
| | CAAGAGCTTCCCCTTCAACACCTCCGTGGTGTACAAGAAAACCCTGTTCGTGGAATTCACCGACCACCTGTTCAATATCGCCAAGCCTCGGCCTCCTT |
| | GGATGGGACTGCTGGGACCTACAATTCAGGCCGAGGTGTACGACACCGTGGTCATCACCCTGAAGAACATGGCCAGCCATCCTGTGTCTCTGCACGCC |
| | GTGGGAGTGTCTTATTGGAAGGCTTCTGAGGGCGCCGAGTACGACGATCAGACAAGCCAGAGAGAGAAAGAGGACGACAAGGTTTTCCCTGGCGGCAG |
| | CCACACCTATGTCTGGCAGGTCCTGAAAGAAAACGGCCCTATGGCCTCCGATCCTCTGTGCCTGACATACAGCTACCTGAGCCACGTGGACCTGGTCA |
| | AGGACCTGAATTCTGGCCTGATCGGAGCCCTGCTCGTGTGTAGAGAAGGCAGCCTGGCCAAAGAGAAAACCCAGACACTGCACAAGTTCATCCTGCTG |
| | TTCGCCGTGTTCGACGAGGGCAAGAGCTGGCACAGCGAGACAAAGAACAGCCTGATGCAGGACAGGGATGCCGCCTCTGCTAGAGCTTGGCCTAAGAT |
| | GCACACCGTGAACGGCTACGTGAACAGAAGCCTGCCTGGACTGATCGGCTGCCACAGAAAGTCCGTGTACTGGCACGTGATCGGCATGGGCACAACAC |
| | CTGAGGTGCACAGCATCTTTCTGGAAGGCCACACCTTCCTCGTGCGGAACCACAGACAGGCCAGCCTGGAAATCAGCCCTATCACCTTCCTGACCGCT |
| | CAGACCCTGCTGATGGATCTGGGCCAGTTTCTGCTGTTCTGCCACATCAGCTCCCACCAGCACGATGGCATGGAAGCCTACGTGAAGGTGGACAGCTG |
| | CCCCGAAGAACCCCAGCTGCGGATGAAGAACAACGAGGAAGCCGAGGACTACGACGACGACCTGACCGACTCTGAGATGGACGTCGTCAGATTCGACG |
| | ACGATAACAGCCCCAGCTTCATCCAGATCAGAAGCGTGGCCAAGAAGCACCCCAAGACCTGGGTGCACTATATCGCCGCCGAGGAAGAGGACTGGGAT |
| | TACGCTCCTCTGGTGCTGGCCCCTGACGACAGAAGCTACAAGAGCCAGTACCTGAACAACGGCCCTCAGCGGATCGGCCGGAAGTATAAGAAAGTGCG |
| | GTTCATGGCCTACACCGACGAGACATTCAAGACCAGAGAGGCCATCCAGCACGAGAGCGGAATTCTGGGCCCTCTGCTGTATGGCGAAGTGGGCGATA |
| | CACTGCTGATCATCTTCAAGAACCAGGCCAGCAGACCCTACAACATCTACCCTCACGGCATCACCGATGTGCGGCCCCTGTATTCTAGAAGGCTGCCC |
| | AAGGGCGTGAAGCACCTGAAGGACTTCCCTATCCTGCCTGGCGAGATTTTCAAGTACAAGTGGACCGTGACCGTGGAAGATGGCCCCACCAAGAGCGA |
| | CCCTAGATGTCTGACACGGTACTACAGCAGCTTCGTGAACATGGAACGCGACCTGGCCAGCGGCCTGATTGGACCTCTGCTGATCTGCTACAAAGAAA |
| | GCGTGGACCAGCGGGGCAACCAGATCATGAGCGACAAGCGGAACGTGATCCTGTTTAGCGTGTTCGATGAGAACCGGTCCTGGTATCTGACCGAGAAC |
| | ATCCAGCGGTTTCTGCCCAATCCTGCCGGGGTGCAACTGGAAGATCCTGAGTTCCAGGCAAGCAACATCATGCACTCCATCAATGGCTATGTGTTCGA |
| | CAGCCTGCAGCTGAGCGTGTGCCTGCACGAAGTGGCCTACTGGTACATCCTGAGCATTGGCGCCCAGACCGACTTCCTGTCCGTGTTCTTTAGCGGCT |
| | ACACCTTCAAGCACAAGATGGTGTACGAGGATACCCTGACACTGTTCCCATTCAGCGGCGAGACAGTGTTCATGAGCATGGAAAACCCCGGCCTGTGG |
| | ATTCTGGGCTGTCACAACAGCGACTTCCGGAACAGAGGCATGACAGCCCTGCTGAAGGTGTCCAGCTGCGACAAGAACACCGGCGACTACTACGAGGA |
| | CAGCTATGAGGACATCAGCGCCTACCTGCTGAGCAAGAACAATGCCATCGAGCCTCGGAGCTTCAGCCAGAATCCTCCTGTGCTGAAGCGGCACCAGC |
| | GCGAGATCACCAGAACAACCCTGCAGAGCGACCAAGAGGAAATCGATTACGACGACACCATCAGCGTCGAGATGAAGAAAGAAGATTTCGACATCTAC |
| | GACGAGGACGAGAATCAGAGCCCCAGAAGCTTTCAGAAAAAGACCCGGCACTACTTCATTGCCGCCGTCGAGAGACTGTGGGACTACGGCATGTCTAG |
| | CAGCCCTCACGTGCTGAGAAATAGAGCCCAGAGCGGCAGCGTGCCCCAGTTCAAGAAAGTGGTGTTCCAAGAGTTCACCGACGGCAGCTTCACCCAGC |
| | CACTGTATAGAGGCGAGCTGAACGAGCATCTGGGCCTGCTGGGCCCTTATATCAGAGCCGAAGTGGAAGATAACATCATGGTCACCTTCCGGAATCAG |
| | GCTAGCCGGCCTTACAGCTTCTACAGCTCCCTGATCAGCTACGAAGAGGACCAGAGACAGGGCGCTGAGCCCAGAAAGAACTTCGTGAAGCCCAACGA |
| | GACTAAGACCTACTTTTGGAAGGTGCAGCACCACATGGCCCCTACAAAGGACGAGTTCGACTGCAAAGCCTGGGCCTACTTCTCCGATGTGGATCTGG |
| | AAAAGGACGTGCACAGCGGGCTCATCGGACCACTGCTTGTGTGCCACACCAACACACTGAACCCCGCTCACGGCAGACAAGTGACAGTGCAAGAGTTC |
| | GCCCTGTTCTTCACCATCTTCGACGAAACAAAGAGCTGGTACTTCACCGAGAATATGGAACGGAACTGCAGAGCCCCTTGCAACATCCAGATGGAAGA |
| | TCCCACCTTCAAAGAGAACTACCGGTTCCACGCCATCAACGGCTACATCATGGACACACTGCCCGGCCTGGTTATGGCCCAGGATCAGAGAATCCGGT |
| | GGTATCTGCTGTCCATGGGCTCCAACGAGAATATCCACAGCATCCACTTCAGCGGCCACGTGTTCACCGTGCGGAAAAAAGAAGAGTACAAAATGGCC |
| | CTGTACAATCTGTACCCTGGGGTGTTCGAAACCGTGGAAATGCTGCCTTCCAAGGCCGGCATTTGGAGAGTGGAATGTCTGATTGGAGAGCACCTCCA |
| | CGCCGGAATGAGCACCCTGTTTCTGGTGTACAGCAACAAGTGTCAGACCCCTCTCGGCATGGCCTCTGGACACATCAGAGACTTCCAGATCACCGCCT |
| | CTGGCCAGTACGGACAGTGGGCTCCTAAACTGGCTCGGCTGCACTACAGCGGCAGCATCAATGCCTGGTCCACCAAAGAGCCCTTCAGCTGGATCAAG |
| | GTGGACCTGCTGGCTCCCATGATCATCCACGGAATCAAGACCCAGGGCGCCAGACAGAAGTTCAGCAGCCTGTACATCAGCCAGTTCATCATCATGTA |
| | CAGCCTGGACGGCAAGAAGTGGCAGACCTACAGAGGCAACAGCACCGGCACACTCATGGTGTTCTTCGGCAACGTGGACTCCAGCGGCATTAAGCACA |

TABLE 9-continued

| ceDNA Vector Name | Nucleic Acid Sequence |
|---|---|
| | ACATCTTCAACCCTCCAATCATTGCCCGGTACATCCGGCTGCACCCCACACACTACAGCATCCGGTCTACCCTGAGAATGGAACTGATGGGCTGCGAC |
| | CTGAACAGCTGCTCTATGCCCCTCGGAATGGAAAGCAAGGCCATCAGCGACGCCCAGATCACAGCCAGCAGCTACTTCACCAACATGTTCGCCACTTG |
| | GAGCCCCTCCAAGGCTAGACTGCATCTGCAGGGCAGAAGCAACGCTTGGAGGCCCCAAGTGAACAACCCCAAAGAGTGGCTGCAGGTTGACTTTCAAA |
| | AGACCATGAAAGTGACCGGCGTGACCACACAGGGCGTCAAGTCTCTGCTGACCTCTATGTACGTGAAAGAGTTCCTGATCTCCAGCAGCCAGGACGGC |
| | CATCAGTGGACCCTGTTTTTCCAGAACGGCAAAGTGAAAGTGTTCCAGGGCAATCAGGACAGCTTCACACCCGTGGTCAATTCTCTGGACCCTCCACT |
| | GCTGACCAGATACCTGCGGATTCACCCTCAGTCTTGGGTGCACCAGATCGCTCTGCGGATGGAAGTGCTGGGCTGTGAAGCTCAGGACCTCTACTAGT |
| | TAATTAAGAGCATCTTACCGCCATTTATTCCCATATTTGTTCTGTTTTTCTTGATTTGGGTATACATTTAAATGTTAATAAAACAAAATGGTGGGGCA |
| | ATCATTTACATTTTTAGGGATATGTAATTACTAGTTCAGGTGTATTGCCACAAGACAAACATGTTAAGAAACTTTCCCGTTATTTACGCTCTGTTCCT |
| | GTTAATCAACCTCTGGATTACAAAATTTGTGAAAGATTGACTGATATTCTTAACTATGTTGCTCCTTTTACGCTGTGTGGATATGCTGCTTTATAGCC |
| | TCTGTATCTAGCTATTGCTTCCCGTACGGCTTTCGTTTTCTCCTCCTTGTATAAATCCTGGTTGCTGTCTCTTTTAGAGGAGTTGTGGCCCGTTGTCC |
| | GTCAACGTGGCGTGGTGTGCTCTGTGTTTGCTGACGCAACCCCCACTGGCTGGGGCATTGCCACCACCTGTCAACTCCTTTCTGGGACTTTCGCTTTC |
| | CCCCTCCCGATCGCCACGGCAGAACTCATCGCCGCCTGCCTTGCCCGCTGCTGGACAGGGGCTAGGTTGCTGGGCACTGATAATTCCGTGGTGTTGTC |
| | ATCGATTCCATAAAGTAGGAAACACTACACGATTCCATAAAGTAGGAAACACTACATCACTCCATAAAGTAGGAAACACTACAGTTAACTGTGCCTTC |
| | TAGTTGCCAGCCATCTGTTGTTTGCCCCTCCCCCGTGCCTTCCTTGACCCTGGAAGGTGCCACTCCCACTGTCCTTTCCTAATAAAATGAGGAAATTG |
| | CATCGCATTGTCTGAGTAGGTGTCATTCTATTCTGGGGGGTGGGGTGGGGCAGGACAGCAAGGGGGAGGATTGGGAAGACAATAGCAGGCATGCTGGG |
| | GATGCGGTGGGCTCTATGGCGGCGCGCCGCATGGCTACGTAGATAAGTAGCATGGCGGGTTAATCATTAACTACACCTGCAGGAGGAACCCCTAGTGA |
| | TGGAGTTGGCCACTCCCTCTCTGCGCGCTCGCTCGCTCACTGAGGCCGGGCGACCAAAGGTCGCCCGACGCCCGGGCGGCCTCAGTGAGCGAGCGAGC |
| | GCGCAGCTGCCTGCAGGTCGACGCTAGCAGCTGATGCATAGCATGCGGTACCGGGAGATGGGGGAGGCTAACTGAAACACGGAAGGAGACAATACCGG |
| | AAGGAACCCGCGCTATGACGGCAATAAAAAGACAGAATAAAACGCACGGGTGTTGGGTCGTTTGTTCATAAACGCGGGGTTCGGTCCCAGGGCTGGCA |
| | CTCTGTCGATACCCCACCGAGACCCCATTGGGACCAATACGCCCGCGTTTCTTCCTTTTCCCCACCCCAACCCCCAAGTTCGGGTGAAGGCCCAGGGC |
| | TCGCAGCCAACGTCGGGGCGGCAAGCCCTGCCATAGCCACTACGGGTACGTAGGCCAACCACTAGAACTATAGCTAGAGTCCTGGGCGAACAAACGAT |
| | GCTCGCCTTCCAGAAAACCGAGGATGCGAACCACTTCATCCGGGGTCAGCACCACCGGCAAGCGCCGCGACGGCCGAGGTCTACCGATCTCCTGAAGC |
| | CAGGGCAGATCCGTGCACAGCACCTTGCCGTAGAAGAACAGCAAGGCCGCCAATGCCTGACGATGCGTGGAGACCGAAACCTTGCGCTCGTTCGCCAG |
| | CCAGGACAGAAATGCCTCGACTTCGCTGCTGCCCAAGGTTGCCGGGTGACGCACACCGTGGAAACGGATGAAGGCACGAACCCAGTTGACATAAGCCT |
| | GTTCGGTTCGTAAACTGTAATGCAAGTAGCGTATGCGCTCACGCAACTGGTCCAGAACCTTGACCGAACGCAGCGGTGGTAACGGCGCAGTGGCGGTT |
| | TTCATGGCTTGTTATGACTGTTTTTTTGTACAGTCTATGCCTCGGGCATCCAAGCAGCAAGCGCGTTACGCCGTGGGTCGATGTTTGATGTTATGGAG |
| | CAGCAACGATGTTACGCAGCAGCAACGATGTTACGCAGCAGGGCAGTCGCCCTAAAACAAAGTTAGGTGGCTCAAGTATGGGCATCATTCGCACATGT |
| | AGGCTCGGCCCTGACCAAGTCAAATCCATGCGGGCTGCTCTTGATCTTTTCGGTCGTGAGTTCGGAGACGTAGCCACCTACTCCCAACATCAGCCGGA |
| | CTCCGATTACCTCGGGAACTTGCTCCGTAGTAAGACATTCATCGCGCTTGCTGCCTTCGACCAAGAAGCGGTTGTTGGCGCTCTCGCGGCTTACGTTC |
| | TGCCCAGGTTTGAGCAGCCGCGTAGTGAGATCTATATCTATGATCTCGCAGTCTCCGGCGAGCACCGGAGGCAGGGCATTGCCACCGCGCTCATCAAT |
| | CTCCTCAAGCATGAGGCCAACGCGCTTGGTGCTTATGTGATCTACGTGCAAGCAGATTACGGTGACGATCCCGCAGTGGCTCTCTATACAAAGTTGGG |
| | CATACGGGAAGAAGTGATGCACTTTGATATCGACCCAAGTACCGCCACCTAACAATTCGTTCAAGCCGAGATCGGCTTCCCGGCCGCGGAGTTGTTCG |
| | GTAAATTGTCACAACGCCGCGAATATAGTCTTTACCATGCCCTTGGCCACGCCCCTCTTTAATACGACGGGCAATTTGCACTTCAGAAAATGAAGAGT |
| | TTGCTTTAGCCATAACAAAAGTCCAGTATGCTTTTTCACAGCATAACTGGACTGATTTCAGTTTACAACTATTCTGTCTAGTTTAAGACTTTATTGTC |
| | ATAGTTTAGATCTATTTTGTTCAGTTTAAGACTTTATTGTCCGCCCACACCCGCTTACGCAGGGCATCCATTTATTACTCAACCGTAACCGATTTTGC |
| | CAGGTTACGCGGCTGGTCTGCGGTGTGAAATACCGCACAGATGCGTAAGGAGAAAATACCGCATCAGGCGCTCTTCCGCTTCCTCGCTCACTGACTCG |
| | CTGCGCTCGGTCGTTCGGCTGCGGCGAGCGGTATCAGCTCACTCAAAGGCGGTAATACGGTTATCCACAGAATCAGGGGATAACGCAGGAAAGAACAT |
| | GTGAGCAAAAGGCCAGCAAAAGGCCAGGAACCGTAAAAAGGCCGCGTTGCTGGCGTTTTTCCATAGGCTCCGCCCCCCTGACGAGCATCACAAAAATC |
| | GACGCTCAAGTCAGAGGTGGCGAAACCCGACAGGACTATAAAGATACCAGGCGTTTCCCCCTGGAAGCTCCCTCGTGCGCTCTCCTGTTCCGACCCTG |
| | CCGCTTACCGGATACCTGTCCGCCTTTCTCCCTTCGGGAAGCGTGGCGCTTTCTCAATGCTCACGCTGTAGGTATCTCAGTTCGGTGTAGGTCGTTCG |
| | CTCCAAGCTGGGCTGTGTGCACGAACCCCCCGTTCAGCCCGACCGCTGCGCCTTATCCGGTAACTATCGTCTTGAGTCCAACCCGGTAAGACACGACT |
| | TATCGCCACTGGCAGCAGCCACTGGTAACAGGATTAGCAGAGCGAGGTATGTAGGCGGTGCTACAGAGTTCTTGAAGTGGTGGCCTAACTACGGCTAC |
| | ACTAGAAGGACAGTATTTGGTATCTGCGCTCTGCTGAAGCCAGTTACCTTCGGAAAAAGAGTTGGTAGCTCTTGATCCGGCAAACAAACCACCGCTGG |
| | TAGCGGTGGTTTTTTTGTTTGCAAGCAGCAGATTACGCGCAGAAAAAAAGGATCTCAAGAAGATCCTTTGATCTTTTCTACGGGGTCTGACGCTCAGT |
| | GGAACGAAAACTCACGTTAAGGGATTTTGGTCATGAGATTATCAAAAAGGATCTTCACCTAGATCCTTTTAAATTAAAAATGAAGTTTTAAATCAATC |
| | TAAAGTATATATGAGTAAACTTGGTCTGACAGTTACCAATGCTTAATCAGTGAGGCACCTATCTCAGCGATCTGTCTATTTCGTTCATCCATAGTTGC |
| | CTGACTCCCCGTCGTGTAGATAACTACGATACGGGAGGGCTTACCATCTGGCCCCAGTGCTGCAATGATACCGCGAGACCCACGCTCACCGGCTCCAG |
| | ATTTATCAGCAATAAACCAGCCAGCCGGAAGGGCCGAGCGCAGAAGTGGTCCTGCAACTTTATCCGCCTCCATCCAGTCTATTAATTGTTGCCGGGAA |
| | GCTAGAGTAAGTAGTTCGCCAGTTAATAGTTTGCGCAACGTTGTTGCCATTGCTACAGGCATCGTGGTGTCACGCTCGTCGTTTGGTATGGCTTCATT |
| | CAGCTCCGGTTCCCAACGATCAAGGCGAGTTACATGATCCCCCATGTTGTGCAAAAAAGCGGTTAGCTCCTTCGGTCCTCCGATCGTTGTCAGAAGTA |

TABLE 9-continued

| ceDNA Vector Name | Nucleic Acid Sequence |
|---|---|
| | AGTTGGCCGCAGTGTTATCACTCATGGTTATGGCAGCACTGCATAATTCTCTTACTGTCATGCCATCCGTAAGATGCTTTTCTGTGACTGGTGAGTAC<br>TCAACCAAGTCATTCTGAGAATAGTGTATGCGGCGACCGAGTTGCTCTTGCCCGGCGTCAATACGGGATAATACCGCGCCACATAGCAGAACTTTAAA<br>AGTGCTCATCATTGGAAAACGTTCTTCGGGGCGAAAACTCTCAAGGATCTTACCGCTGTTGAGATCCAGTTCGATGTAACCCACTCGTGCACCCAACT<br>GATCTTCAGCATCTTTTACTTTCACCAGCGTTTCTGGGTGAGCAAAAACAGGAAGGCAAAATGCCGCAAAAAAGGGAATAAGGGCGACACGGAAATGT<br>TGAATACTCATACTCTTCCTTTTTCAATATTATTGAAGCATTTATCAGGGTTATTGTCTCATGAGCGGATACATATTTGAATGTATTTAGAAAAATAA<br>ACAAATAGGGGTTCCGCGCACATTTCCCCGAAAAGTGCCACCTGAAATTGTAAACGTTAATATTTTGTTAAAATTCGCGTTAAATTTTTGTTAAATCA<br>GCTCATTTTTTAACCAATAGGCCGAAATCGGCAAAATCCCTTATAAATCAAAAGAATAGACCGAGATAGGGTTGAGTGTTGTTCCAGTTTGGAACAAG<br>AGTCCACTATTAAAGAACGTGGACTCCAACGTCAAAGGGCGAAAAACCGTCTATCAGGGCGATGGCCCACTACGTGAACCATCACCCTAATCAAGTTT<br>TTTGGGGTCGAGGTGCCGTAAAGCACTAAATCGGAACCCTAAAGGGAGCCCCCGATTTAGAGCTTGACGGGGAAAGCCGGCGAACGTGGCGAGAAAGG<br>AAGGGAAGAAAGCGAAAGGAGCGGGCGCTAGGGCGCTGGCAAGTGTAGCGGTCACGCTGCGCGTAACCACCACACCCGCCGCGCTTAATGCGCCGCTA<br>CAGGGCGCGTCCCATTCGCCATTCAGGCTGCAAATAAGCGTTGATATTCAGTCAATTACAAACATTAATAACGAAGAGATGACAGAAAAATTTTCATT<br>CTGTGACAGAGAA |
| ceDNAFVIII-vector 10 (SEQ ID NO: 201) | AAAGTAGCCGAAGATGACGGTTTGTCACATGGAGTTGGCAGGATGTTTGATTAAAAACATAACAGGAAGAAAAATGCCCCGCTGTGGGCGGACAAAAT<br>AGTTGGGAACTGGGAGGGGTGGAAATGGAGTTTTTAAGGATTATTTAGGGAAGAGTGACAAAATAGATGGGAACTGGGTGTAGCGTCGTAAGCTAATA<br>CGAAAATTAAAAATGACAAAATAGTTTGGAACTAGATTTCACTTATCTGGTTCGGATCTCCTAGGCCTGCAGGCAGCTGCGCGCTCGCTCGCTCACTG<br>AGGCCGCCCGGGCAAAGCCCGGGCGTCGGGCGACCTTTGGTCGCCCGGCCTCAGTGAGCGAGCGAGCGCGCAGAGAGGGAGTGGCCAACTCCATCACT<br>AGGGGTTCCTTGTAGTTAATGATTAACCCGCCATGCTACTTATCGCGGCCGCAGGCTCAGAGGCACACAGGAGTTTCTGGGCTCACCCTGCCCCCTTC<br>CAACCCCTCAGTTCCCATCCTCCAGCAGCTGTTTGTGTGCTGCCTCTGAAGTCCACACTGAACAAACTTCAGCCTACTCATGTCCCTAAAATGGGCAA<br>ACATTGCAAGCAGCAAACAGCAAACACACAGCCCTCCCTGCCTGCTGACCTTGGAGCTGGGGCAGAGGTCAGAGACCTCTCTGGGCCCATGCCACCTC<br>CAACATCCACTCGACCCCTTGGAATTTCGGTGGAGAGGAGCAGAGGTTGTCCTGGCGTGGTTTAGGTAGTGTGAGAGGGTCCGGGTTCAAAACCACTT<br>GCTGGGTGGGGAGTCGTCAGTAAGTGGCTATGCCCCGACCCCGAAGCCTGTTTCCCCATCTGTACAATGGAAATGATAAAGACGCCCATCTGATAGGG<br>TTTTTGTGGCAAATAAACATTTGGTTTTTTTGTTTTGTTTTGTTTTGTTTTTTGAGATGGAGGTTTGCTCTGTCGCCCAGGCTGGAGTGCAGTGACAC<br>AATCTCATCTCACCACAACCTTCCCCTGCCTCAGCCTCCCAAGTAGCTGGGATTACAAGCATGTGCCACCACACCTGGCTAATTTTCTATTTTTAGTA<br>GAGACGGGTTTCTCCATGTTGGTCAGCCTCAGCCTCCCAAGTAACTGGGATTACAGGCCTGTGCCACCACACCCGGCTAATTTTTTCTATTTTTGACA<br>GGGACGGGGTTTCACCATGTTGGTCAGGCTGGTCTAGAGGTACCG**GATCTTGCTACCAGTGGAACAGCCACTAAGGATTCTGCAGTGAGAGCAGAGGG**<br>**CCAGCTAAGTGGTACTCTCCCAGAGACTGTCTGACTCACGCCACCCCCTCCACCTTGGACACAGGACGCTGTGGTTTCTGAGCCAGGTACAATGACTC**<br>**CTTTCGGTAAGTGCAGTGGAAGCTGTACACTGCCCAGGCAAAGCGTCCGGGCAGCGTAGGCGGGCGACTCAGATCCCAGCCAGTGGACTTAGCCCCTG**<br>**TTTGCT**CCTCCGATAACTGGGGTGACCTTGGTTAATATTCACCAGCAGCCTCCCCCGTTGCCCCTCTGGATCCACTGCTTAAATACGGACGAGGACAG<br>GGCCCTGTCTCCTCAGCTTCAGGCACCACCACTGACCTGGGACAGTGAATCCGGACTCTAAGGTAAATATAAAATTTTTAAGTGTATAATGTGTTAAA<br>CTACTGATTCTAATTGTTTCTCTCTTTTAGATTCCAACCTTTGGAACTGAGTTTAAACCGCAGCCACCATGCAGATCGAGCTGTCTACCTGCTTCTTC<br>CTGTGCCTGCTGCGGTTCTGCTTCAGCGCCACCAGAAGATATTACCTGGGCGCCGTGGAACTGAGCTGGGACTACATGCAGTCTGACCTGGGAGAGCT<br>GCCCGTGGACGCTAGATTTCCTCCAAGAGTGCCCAAGAGCTTCCCCTTCAACACCTCCGTGGTGTACAAGAAAACCCTGTTCGTGGAATTCACCGACC<br>ACCTGTTCAATATCGCCAAGCCTCGGCCTCCTTGGATGGGACTGCTGGGACCTACAATTCAGGCCGAGGTGTACGACACCGTGGTCATCACCCTGAAG<br>AACATGGCCAGCCATCCTGTGTCTCTGCACGCCGTGGGAGTGTCTTATTGGAAGGCTTCTGAGGGCGCCGAGTACGACGATCAGACAAGCCAGAGAGA<br>GAAAGAGGACGACAAGGTTTTCCCTGGCGGCAGCCACACCTATGTCTGGCAGGTCCTGAAAGAAAACGGCCCTATGGCCTCCGATCCTCTGTGCCTGA<br>CATACAGCTACCTGAGCCACGTGGACCTGGTCAAGGACCTGAATTCTGGCCTGATCGGAGCCCTGCTCGTGTGTAGAGAAGGCAGCCTGGCCAAAGAG<br>AAAACCCAGACACTGCACAAGTTCATCCTGCTGTTCGCCGTGTTCGACGAGGGCAAGAGCTGGCACAGCGAGACAAAGAACAGCCTGATGCAGGACAG<br>GGATGCCGCCTCTGCTAGAGCTTGGCCTAAGATGCACACCGTGAACGGCTACGTGAACAGAAGCCTGCCTGGACTGATCGGCTGCCACAGAAAGTCCG<br>TGTACTGGCACGTGATCGGCATGGGCACAACACCTGAGGTGCACAGCATCTTTCTGGAAGGCCACACCTTCCTCGTGCGGAACCACAGACAGGCCAGC<br>CTGGAAATCAGCCCTATCACCTTCCTGACCGCTCAGACCCTGCTGATGGATCTGGGCCAGTTTCTGCTGTTCTGCCACATCAGCTCCCACCAGCACGA<br>TGGCATGGAAGCCTACGTGAAGGTGGACAGCTGCCCCGAAGAACCCCAGCTGCGGATGAAGAACAACGAGGAAGCCGAGGACTACGACGACGACCTGA<br>CCGACTCTGAGATGGACGTCGTCAGATTCGACGACGATAACAGCCCCAGCTTCATCCAGATCAGAAGCGTGGCCAAGAAGCACCCCAAGACCTGGGTG<br>CACTATATCGCCGCCGAGGAAGAGGACTGGGATTACGCTCCTCTGGTGCTGGCCCCTGACGACAGAAGCTACAAGAGCCAGTACCTGAACAACGGCCC<br>TCAGCGGATCGGCCGGAAGTATAAGAAAGTGCGGTTCATGGCCTACACCGACGAGACATTCAAGACCAGAGAGGCCATCCAGCACGAGAGCGGAATTC<br>TGGGCCCTCTGCTGTATGGCGAAGTGGGCGATACACTGCTGATCATCTTCAAGAACCAGGCCAGCAGACCCTACAACATCTACCCTCACGGCATCACC<br>GATGTGCGGCCCCTGTATTCTAGAAGGCTGCCCAAGGGCGTGAAGCACCTGAAGGACTTCCCTATCCTGCCTGGCGAGATTTTCAAGTACAAGTGGAC<br>CGTGACCGTGGAAGATGGCCCCACCAAGAGCGACCCTAGATGTCTGACACGGTACTACAGCAGCTTCGTGAACATGGAACGCGACCTGGCCAGCGGCC<br>TGATTGGACCTCTGCTGATCTGCTACAAAGAAAGCGTGGACCAGCGGGGCAACCAGATCATGAGCGACAAGCGGAACGTGATCCTGTTTAGCGTGTTC<br>GATGAGAACCGGTCCTGGTATCTGACCGAGAACATCCAGCGGTTTCTGCCCAATCCTGCCGGGGTGCAACTGGAAGATCCTGAGTTCCAGGCAAGCAA |

TABLE 9-continued

| ceDNA Vector Name | Nucleic Acid Sequence |
| --- | --- |
| | CATCATGCACTCCATCAATGGCTATGTGTTCGACAGCCTGCAGCTGAGCGTGTGCCTGCACGAAGTGGCCTACTGGTACATCCTGAGCATTGGCGCCC |
| | AGACCGACTTCCTGTCCGTGTTCTTTAGCGGCTACACCTTCAAGCACAAGATGGTGTACGAGGATACCCTGACACTGTTCCCATTCAGCGGCGAGACA |
| | GTGTTCATGAGCATGGAAAACCCCGGCCTGTGGATTCTGGGCTGTCACAACAGCGACTTCCGGAACAGAGGCATGACAGCCCTGCTGAAGGTGTCCAG |
| | CTGCGACAAGAACACCGGCGACTACTACGAGGACAGCTATGAGGACATCAGCGCCTACCTGCTGAGCAAGAACAATGCCATCGAGCCTCGGAGCTTCA |
| | GCCAGAATCCTCCTGTGCTGAAGCGGCACCAGCGCGAGATCACCAGAACAACCCTGCAGAGCGACCAAGAGGAAATCGATTACGACGACACCATCAGC |
| | GTCGAGATGAAGAAAGAAGATTTCGACATCTACGACGAGGACGAGAATCAGAGCCCCAGAAGCTTTCAGAAAAAGACCCGGCACTACTTCATTGCCGC |
| | CGTCGAGAGACTGTGGGACTACGGCATGTCTAGCAGCCCTCACGTGCTGAGAAATAGAGCCCAGAGCGGCAGCGTGCCCCAGTTCAAGAAAGTGGTGT |
| | TCCAAGAGTTCACCGACGGCAGCTTCACCCAGCCACTGTATAGAGGCGAGCTGAACGAGCATCTGGGCCTGCTGGGCCCTTATATCAGAGCCGAAGTG |
| | GAAGATAACATCATGGTCACCTTCCGGAATCAGGCTAGCCGGCCTTACAGCTTCTACAGCTCCCTGATCAGCTACGAAGAGGACCAGAGACAGGGCGC |
| | TGAGCCCAGAAAGAACTTCGTGAAGCCCAACGAGACTAAGACCTACTTTTGGAAGGTGCAGCACCACATGGCCCCTACAAAGGACGAGTTCGACTGCA |
| | AAGCCTGGGCCTACTTCTCCGATGTGGATCTGGAAAAGGACGTGCACAGCGGGCTCATCGGACCACTGCTTGTGTGCCACACCAACACACTGAACCCC |
| | GCTCACGGCAGACAAGTGACAGTGCAAGAGTTCGCCCTGTTCTTCACCATCTTCGACGAAACAAAGAGCTGGTACTTCACCGAGAATATGGAACGGAA |
| | CTGCAGAGCCCCTTGCAACATCCAGATGGAAGATCCCACCTTCAAAGAGAACTACCGGTTCCACGCCATCAACGGCTACATCATGGACACACTGCCCG |
| | GCCTGGTTATGGCCCAGGATCAGAGAATCCGGTGGTATCTGCTGTCCATGGGCTCCAACGAGAATATCCACAGCATCCACTTCAGCGGCCACGTGTTC |
| | ACCGTGCGGAAAAAAGAAGAGTACAAAATGGCCCTGTACAATCTGTACCCTGGGGTGTTCGAAACCGTGGAAATGCTGCCTTCCAAGGCCGGCATTTG |
| | GAGAGTGGAATGTCTGATTGGAGAGCACCTCCACGCCGGAATGAGCACCCTGTTTCTGGTGTACAGCAACAAGTGTCAGACCCCTCTCGGCATGGCCT |
| | CTGGACACATCAGAGACTTCCAGATCACCGCCTCTGGCCAGTACGGACAGTGGGCTCCTAAACTGGCTCGGCTGCACTACAGCGGCAGCATCAATGCC |
| | TGGTCCACCAAAGAGCCCTTCAGCTGGATCAAGGTGGACCTGCTGGCTCCCATGATCATCCACGGAATCAAGACCCAGGGCGCCAGACAGAAGTTCAG |
| | CAGCCTGTACATCAGCCAGTTCATCATCATGTACAGCCTGGACGGCAAGAAGTGGCAGACCTACAGAGGCAACAGCACCGGCACACTCATGGTGTTCT |
| | TCGGCAACGTGGACTCCAGCGGCATTAAGCACAACATCTTCAACCCTCCAATCATTGCCCGGTACATCCGGCTGCACCCCACACACTACAGCATCCGG |
| | TCTACCCTGAGAATGGAACTGATGGGCTGCGACCTGAACAGCTGCTCTATGCCCCTCGGAATGGAAAGCAAGGCCATCAGCGACGCCCAGATCACAGC |
| | CAGCAGCTACTTCACCAACATGTTCGCCACTTGGAGCCCCTCCAAGGCTAGACTGCATCTGCAGGGCAGAAGCAACGCTTGGAGGCCCCAAGTGAACA |
| | ACCCCAAAGAGTGGCTGCAGGTTGACTTTCAAAAGACCATGAAAGTGACCGGCGTGACCACACAGGGCGTCAAGTCTCTGCTGACCTCTATGTACGTG |
| | AAAGAGTTCCTGATCTCCAGCAGCCAGGACGGCCATCAGTGGACCCTGTTTTTCCAGAACGGCAAAGTGAAAGTGTTCCAGGGCAATCAGGACAGCTT |
| | CACACCCGTGGTCAATTCTCTGGACCCTCCACTGCTGACCAGATACCTGCGGATTCACCCTCAGTCTTGGGTGCACCAGATCGCTCTGCGGATGGAAG |
| | TGCTGGGCTGTGAAGCTCAGGACCTCTACTAGTTAATTAAGAGCATCTTACCGCCATTTATTCCCATATTTGTTCTGTTTTTCTTGATTTGGGTATAC |
| | ATTTAAATGTTAATAAAACAAAATGGTGGGGCAATCATTTACATTTTTAGGGATATGTAATTACTAGTTCAGGTGTATTGCCACAAGACAAACATGTT |
| | AAGAAACTTTCCCGTTATTTACGCTCTGTTCCTGTTAATCAACCTCTGGATTACAAAATTTGTGAAAGATTGACTGATATTCTTAACTATGTTGCTCC |
| | TTTTACGCTGTGTGGATATGCTGCTTTATAGCCTCTGTATCTAGCTATTGCTTCCCGTACGGCTTTCGTTTTCTCCTCCTTGTATAAATCCTGGTTGC |
| | TGTCTCTTTTAGAGGAGTTGTGGCCCGTTGTCCGTCAACGTGGCGTGGTGTGCTCTGTGTTTGCTGACGCAACCCCCACTGGCTGGGGCATTGCCACC |
| | ACCTGTCAACTCCTTTCTGGGACTTTCGCTTTCCCCCTCCCGATCGCCACGGCAGAACTCATCGCCGCCTGCCTTGCCCGCTGCTGGACAGGGGCTAG |
| | GTTGCTGGGCACTGATAATTCCGTGGTGTTGTCATCGATTCCATAAAGTAGGAAACACTACACGATTCCATAAAGTAGGAAACACTACATCACTCCAT |
| | AAAGTAGGAAACACTACAGTTAACTGTGCCTTCTAGTTGCCAGCCATCTGTTGTTTGCCCCTCCCCCGTGCCTTCCTTGACCCTGGAAGGTGCCACTC |
| | CCACTGTCCTTTCCTAATAAAATGAGGAAATTGCATCGCATTGTCTGAGTAGGTGTCATTCTATTCTGGGGGGTGGGGTGGGGCAGGACAGCAAGGGG |
| | GAGGATTGGGAAGACAATAGCAGGCATGCTGGGGATGCGGTGGGCTCTATGGCGGCGCGCCGCATGGCTACGTAGATAAGTAGCATGGCGGGTTAATC |
| | ATTAACTACACCTGCAGGAGGAACCCCTAGTGATGGAGTTGGCCACTCCCTCTCTGCGCGCTCGCTCGCTCACTGAGGCCGGGCGACCAAAGGTCGCC |
| | CGACGCCCGGGCGGCCTCAGTGAGCGAGCGAGCGCGCAGCTGCCTGCAGGTCGACGCTAGCAGCTGATGCATAGCATGCGGTACCGGGAGATGGGGGA |
| | GGCTAACTGAAACACGGAAGGAGACAATACCGGAAGGAACCCGCGCTATGACGGCAATAAAAAGACAGAATAAAACGCACGGGTGTTGGGTCGTTTGT |
| | TCATAAACGCGGGGTTCGGTCCCAGGGCTGGCACTCTGTCGATACCCCACCGAGACCCCATTGGGACCAATACGCCCGCGTTTCTTCCTTTTCCCCAC |
| | CCCAACCCCCAAGTTCGGGTGAAGGCCCAGGGCTCGCAGCCAACGTCGGGGCGGCAAGCCCTGCCATAGCCACTACGGGTACGTAGGCCAACCACTAG |
| | AACTATAGCTAGAGTCCTGGGCGAACAAACGATGCTCGCCTTCCAGAAAACCGAGGATGCGAACCACTTCATCCGGGGTCAGCACCACCGGCAAGCGC |
| | CGCGACGGCCGAGGTCTACCGATCTCCTGAAGCCAGGGCAGATCCGTGCACAGCACCTTGCCGTAGAAGAACAGCAAGGCCGCCAATGCCTGACGATG |
| | CGTGGAGACCGAAACCTTGCGCTCGTTCGCCAGCCAGGACAGAAATGCCTCGACTTCGCTGCTGCCCAAGGTTGCCGGGTGACGCACACCGTGGAAAC |
| | GGATGAAGGCACGAACCCAGTTGACATAAGCCTGTTCGGTTCGTAAACTGTAATGCAAGTAGCGTATGCGCTCACGCAACTGGTCCAGAACCTTGACC |
| | GAACGCAGCGGTGGTAACGGCGCAGTGGCGGTTTTCATGGCTTGTTATGACTGTTTTTTTGTACAGTCTATGCCTCGGGCATCCAAGCAGCAAGCGCG |
| | TTACGCCGTGGGTCGATGTTTGATGTTATGGAGCAGCAACGATGTTACGCAGCAGCAACGATGTTACGCAGCAGGGCAGTCGCCCTAAAACAAAGTTA |
| | GGTGGCTCAAGTATGGGCATCATTCGCACATGTAGGCTCGGCCCTGACCAAGTCAAATCCATGCGGGCTGCTCTTGATCTTTTCGGTCGTGAGTTCGG |
| | AGACGTAGCCACCTACTCCCAACATCAGCCGGACTCCGATTACCTCGGGAACTTGCTCCGTAGTAAGACATTCATCGCGCTTGCTGCCTTCGACCAAG |
| | AAGCGGTTGTTGGCGCTCTCGCGGCTTACGTTCTGCCCAGGTTTGAGCAGCCGCGTAGTGAGATCTATATCTATGATCTCGCAGTCTCCGGCGAGCAC |
| | CGGAGGCAGGGCATTGCCACCGCGCTCATCAATCTCCTCAAGCATGAGGCCAACGCGCTTGGTGCTTATGTGATCTACGTGCAAGCAGATTACGGTGA |

TABLE 9-continued

| ceDNA Vector Name | Nucleic Acid Sequence |
|---|---|
| | CGATCCCGCAGTGGCTCTCTATACAAAGTTGGGCATACGGGAAGAAGTGATGCACTTTGATATCGACCCAAGTACCGCCACCTAACAATTCGTTCAAG<br>CCGAGATCGGCTTCCCGGCCGCGGAGTTGTTCGGTAAATTGTCACAACGCCGCGAATATAGTCTTTACCATGCCCTTGGCCACGCCCCTCTTTAATAC<br>GACGGGCAATTTGCACTTCAGAAAATGAAGAGTTTGCTTTAGCCATAACAAAAGTCCAGTATGCTTTTTCACAGCATAACTGGACTGATTTCAGTTTA<br>CAACTATTCTGTCTAGTTTAAGACTTTATTGTCATAGTTTAGATCTATTTTGTTCAGTTTAAGACTTTATTGTCCGCCCACACCCGCTTACGCAGGGC<br>ATCCATTTATTACTCAACCGTAACCGATTTTGCCAGGTTACGCGGCTGGTCTGCGGTGTGAAATACCGCACAGATGCGTAAGGAGAAAATACCGCATC<br>AGGCGCTCTTCCGCTTCCTCGCTCACTGACTCGCTGCGCTCGGTCGTTCGGCTGCGGCGAGCGGTATCAGCTCACTCAAAGGCGGTAATACGGTTATC<br>CACAGAATCAGGGGATAACGCAGGAAAGAACATGTGAGCAAAAGGCCAGCAAAAGGCCAGGAACCGTAAAAAGGCCGCGTTGCTGGCGTTTTTCCATA<br>GGCTCCGCCCCCCTGACGAGCATCACAAAAATCGACGCTCAAGTCAGAGGTGGCGAAACCCGACAGGACTATAAAGATACCAGGCGTTTCCCCCTGGA<br>AGCTCCCTCGTGCGCTCTCCTGTTCCGACCCTGCCGCTTACCGGATACCTGTCCGCCTTTCTCCCTTCGGGAAGCGTGGCGCTTTCTCAATGCTCACG<br>CTGTAGGTATCTCAGTTCGGTGTAGGTCGTTCGCTCCAAGCTGGGCTGTGTGCACGAACCCCCCGTTCAGCCCGACCGCTGCGCCTTATCCGGTAACT<br>ATCGTCTTGAGTCCAACCCGGTAAGACACGACTTATCGCCACTGGCAGCAGCCACTGGTAACAGGATTAGCAGAGCGAGGTATGTAGGCGGTGCTACA<br>GAGTTCTTGAAGTGGTGGCCTAACTACGGCTACACTAGAAGGACAGTATTTGGTATCTGCGCTCTGCTGAAGCCAGTTACCTTCGGAAAAAGAGTTGG<br>TAGCTCTTGATCCGGCAAACAAACCACCGCTGGTAGCGGTGGTTTTTTTGTTTGCAAGCAGCAGATTACGCGCAGAAAAAAAGGATCTCAAGAAGATC<br>CTTTGATCTTTTCTACGGGGTCTGACGCTCAGTGGAACGAAAACTCACGTTAAGGGATTTTGGTCATGAGATTATCAAAAAGGATCTTCACCTAGATC<br>CTTTTAAATTAAAAATGAAGTTTTAAATCAATCTAAAGTATATATGAGTAAACTTGGTCTGACAGTTACCAATGCTTAATCAGTGAGGCACCTATCTC<br>AGCGATCTGTCTATTTCGTTCATCCATAGTTGCCTGACTCCCCGTCGTGTAGATAACTACGATACGGGAGGGCTTACCATCTGGCCCCAGTGCTGCAA<br>TGATACCGCGAGACCCACGCTCACCGGCTCCAGATTTATCAGCAATAAACCAGCCAGCCGGAAGGGCCGAGCGCAGAAGTGGTCCTGCAACTTTATCC<br>GCCTCCATCCAGTCTATTAATTGTTGCCGGGAAGCTAGAGTAAGTAGTTCGCCAGTTAATAGTTTGCGCAACGTTGTTGCCATTGCTACAGGCATCGT<br>GGTGTCACGCTCGTCGTTTGGTATGGCTTCATTCAGCTCCGGTTCCCAACGATCAAGGCGAGTTACATGATCCCCCATGTTGTGCAAAAAAGCGGTTA<br>GCTCCTTCGGTCCTCCGATCGTTGTCAGAAGTAAGTTGGCCGCAGTGTTATCACTCATGGTTATGGCAGCACTGCATAATTCTCTTACTGTCATGCCA<br>TCCGTAAGATGCTTTTCTGTGACTGGTGAGTACTCAACCAAGTCATTCTGAGAATAGTGTATGCGGCGACCGAGTTGCTCTTGCCCGGCGTCAATACG<br>GGATAATACCGCGCCACATAGCAGAACTTTAAAAGTGCTCATCATTGGAAAACGTTCTTCGGGGCGAAAACTCTCAAGGATCTTACCGCTGTTGAGAT<br>CCAGTTCGATGTAACCCACTCGTGCACCCAACTGATCTTCAGCATCTTTTACTTTCACCAGCGTTTCTGGGTGAGCAAAAACAGGAAGGCAAAATGCC<br>GCAAAAAAGGGAATAAGGGCGACACGGAAATGTTGAATACTCATACTCTTCCTTTTTCAATATTATTGAAGCATTTATCAGGGTTATTGTCTCATGAG<br>CGGATACATATTTGAATGTATTTAGAAAAATAAACAAATAGGGGTTCCGCGCACATTTCCCCGAAAAGTGCCACCTGAAATTGTAAACGTTAATATTT<br>TGTTAAAATTCGCGTTAAATTTTTGTTAAATCAGCTCATTTTTTAACCAATAGGCCGAAATCGGCAAAATCCCTTATAAATCAAAAGAATAGACCGAG<br>ATAGGGTTGAGTGTTGTTCCAGTTTGGAACAAGAGTCCACTATTAAAGAACGTGGACTCCAACGTCAAAGGGCGAAAAACCGTCTATCAGGGCGATGG<br>CCCACTACGTGAACCATCACCCTAATCAAGTTTTTTGGGGTCGAGGTGCCGTAAAGCACTAAATCGGAACCCTAAAGGGAGCCCCCGATTTAGAGCTT<br>GACGGGGAAAGCCGGCGAACGTGGCGAGAAAGGAAGGGAAGAAAGCGAAAGGAGCGGGCGCTAGGGCGCTGGCAAGTGTAGCGGTCACGCTGCGCGTA<br>ACCACCACACCCGCCGCGCTTAATGCGCCGCTACAGGGCGCGTCCCATTCGCCATTCAGGCTGCAAATAAGCGTTGATATTCAGTCAATTACAAACAT<br>TAATAACGAAGAGATGACAGAAAAATTTTCATTCTGTGACAGAGAA |
| ceDNAFVIII-vector 11 (SEQ ID NO: 202) | AAAGTAGCCGAAGATGACGGTTTGTCACATGGAGTTGGCAGGATGTTTGATTAAAAACATAACAGGAAGAAAAATGCCCCGCTGTGGGCGGACAAAAT<br>AGTTGGGAACTGGGAGGGGTGGAAATGGAGTTTTTAAGGATTATTTAGGGAAGAGTGACAAAATAGATGGGAACTGGGTGTAGCGTCGTAAGCTAATA<br>CGAAAATTAAAAATGACAAAATAGTTTGGAACTAGATTTCACTTATCTGGTTCGGATCTCCTAGGCCTGCAGGCAGCTGCGCGCTCGCTCGCTCACTG<br>AGGCCGCCCGGGCAAAGCCCGGGCGTCGGGCGACCTTTGGTCGCCCGGCCTCAGTGAGCGAGCGAGCGCGCAGAGAGGGAGTGGCCAACTCCATCACT<br>AGGGGTTCCTTGTAGTTAATGATTAACCCGCCATGCTACTTATCGCGGCCGC**CGGGGGAGGCTGCTGGTGAATATTAACCAAGGTCACCCCAGTTATC**<br>**GGAGGAGCAAACAGGGGCTAAGTCCACACGCGTGGTACCGTCTGTCTGCACATTTCGTAGAGCGAGTGTTCCGATACTCTAATCTCCCTAGGCAAGGT**<br>**TCATATTTGTGTAGGTTACTTATTCTCCTTTTGTTGACTAAGTCAATAATCAGAATCAGCAGGTTTGGAGTCAGCTTGGCAGGGATCAGCAGCCTGGG**<br>**TTGGAAGGAGGGG**GTATAAAAGCCCCTTCACCAGGAGAAGCCGTCACACAGATCCACAAGCTCCTGAAGAGGTAAGGGTTTAAGGGATGGTTGGTTGG<br>TGGGGTATTAATGTTTAATTACCTGGAGCACCTGCCTGAAATCACTTTTTTTCAGGTTGGTTTAAACCGCAGCCACCATGCAGATCGAGCTGTCTACC<br>TGCTTCTTCCTGTGCCTGCTGCGGTTCTGCTTCAGCGCCACCAGAAGATATTACCTGGGCGCCGTGGAACTGAGCTGGGACTACATGCAGTCTGACCT<br>GGGAGAGCTGCCCGTGGACGCTAGATTTCCTCCAAGAGTGCCCAAGAGCTTCCCCTTCAACACCTCCGTGGTGTACAAGAAAACCCTGTTCGTGGAAT<br>TCACCGACCACCTGTTCAATATCGCCAAGCCTCGGCCTCCTTGGATGGGACTGCTGGGACCTACAATTCAGGCCGAGGTGTACGACACCGTGGTCATC<br>ACCCTGAAGAACATGGCCAGCCATCCTGTGTCTCTGCACGCCGTGGGAGTGTCTTATTGGAAGGCTTCTGAGGGCGCCGAGTACGACGATCAGACAAG<br>CCAGAGAGAGAAAGAGGACGACAAGGTTTTCCCTGGCGGCAGCCACACCTATGTCTGGCAGGTCCTGAAAGAAAACGGCCCTATGGCCTCCGATCCTC<br>TGTGCCTGACATACAGCTACCTGAGCCACGTGGACCTGGTCAAGGACCTGAATTCTGGCCTGATCGGAGCCCTGCTCGTGTGTAGAGAAGGCAGCCTG<br>GCCAAAGAGAAAACCCAGACACTGCACAAGTTCATCCTGCTGTTCGCCGTGTTCGACGAGGGCAAGAGCTGGCACAGCGAGACAAAGAACAGCCTGAT<br>GCAGGACAGGGATGCCGCCTCTGCTAGAGCTTGGCCTAAGATGCACACCGTGAACGGCTACGTGAACAGAAGCCTGCCTGGACTGATCGGCTGCCACA<br>GAAAGTCCGTGTACTGGCACGTGATCGGCATGGGCACAACACCTGAGGTGCACAGCATCTTTCTGGAAGGCCACACCTTCCTCGTGCGGAACCACAGA |

TABLE 9-continued

| ceDNA Vector Name | Nucleic Acid Sequence |
|---|---|
| | CAGGCCAGCCTGGAAATCAGCCCTATCACCTTCCTGACCGCTCAGACCCTGCTGATGGATCTGGGCCAGTTTCTGCTGTTCTGCCACATCAGCTCCCA<br>CCAGCACGATGGCATGGAAGCCTACGTGAAGGTGGACAGCTGCCCCGAAGAACCCCAGCTGCGGATGAAGAACAACGAGGAAGCCGAGGACTACGACG<br>ACGACCTGACCGACTCTGAGATGGACGTCGTCAGATTCGACGACGATAACAGCCCCAGCTTCATCCAGATCAGAAGCGTGGCCAAGAAGCACCCCAAG<br>ACCTGGGTGCACTATATCGCCGCCGAGGAAGAGGACTGGGATTACGCTCCTCTGGTGCTGGCCCCTGACGACAGAAGCTACAAGAGCCAGTACCTGAA<br>CAACGGCCCTCAGCGGATCGGCCGGAAGTATAAGAAAGTGCGGTTCATGGCCTACACCGACGAGACATTCAAGACCAGAGAGGCCATCCAGCACGAGA<br>GCGGAATTCTGGGCCCTCTGCTGTATGGCGAAGTGGGCGATACACTGCTGATCATCTTCAAGAACCAGGCCAGCAGACCCTACAACATCTACCCTCAC<br>GGCATCACCGATGTGCGGCCCCTGTATTCTAGAAGGCTGCCCAAGGGCGTGAAGCACCTGAAGGACTTCCCTATCCTGCCTGGCGAGATTTTCAAGTA<br>CAAGTGGACCGTGACCGTGGAAGATGGCCCCACCAAGAGCGACCCTAGATGTCTGACACGGTACTACAGCAGCTTCGTGAACATGGAACGCGACCTGG<br>CCAGCGGCCTGATTGGACCTCTGCTGATCTGCTACAAAGAAAGCGTGGACCAGCGGGGCAACCAGATCATGAGCGACAAGCGGAACGTGATCCTGTTT<br>AGCGTGTTCGATGAGAACCGGTCCTGGTATCTGACCGAGAACATCCAGCGGTTTCTGCCCAATCCTGCCGGGGTGCAACTGGAAGATCCTGAGTTCCA<br>GGCAAGCAACATCATGCACTCCATCAATGGCTATGTGTTCGACAGCCTGCAGCTGAGCGTGTGCCTGCACGAAGTGGCCTACTGGTACATCCTGAGCA<br>TTGGCGCCCAGACCGACTTCCTGTCCGTGTTCTTTAGCGGCTACACCTTCAAGCACAAGATGGTGTACGAGGATACCCTGACACTGTTCCCATTCAGC<br>GGCGAGACAGTGTTCATGAGCATGGAAAACCCCGGCCTGTGGATTCTGGGCTGTCACAACAGCGACTTCCGGAACAGAGGCATGACAGCCCTGCTGAA<br>GGTGTCCAGCTGCGACAAGAACACCGGCGACTACTACGAGGACAGCTATGAGGACATCAGCGCCTACCTGCTGAGCAAGAACAATGCCATCGAGCCTC<br>GGAGCTTCAGCCAGAATCCTCCTGTGCTGAAGCGGCACCAGCGCGAGATCACCAGAACAACCCTGCAGAGCGACCAAGAGGAAATCGATTACGACGAC<br>ACCATCAGCGTCGAGATGAAGAAAGAAGATTTCGACATCTACGACGAGGACGAGAATCAGAGCCCCAGAAGCTTTCAGAAAAAGACCCGGCACTACTT<br>CATTGCCGCCGTCGAGAGACTGTGGGACTACGGCATGTCTAGCAGCCCTCACGTGCTGAGAAATAGAGCCCAGAGCGGCAGCGTGCCCCAGTTCAAGA<br>AAGTGGTGTTCCAAGAGTTCACCGACGGCAGCTTCACCCAGCCACTGTATAGAGGCGAGCTGAACGAGCATCTGGGCCTGCTGGGCCCTTATATCAGA<br>GCCGAAGTGGAAGATAACATCATGGTCACCTTCCGGAATCAGGCTAGCCGGCCTTACAGCTTCTACAGCTCCCTGATCAGCTACGAAGAGGACCAGAG<br>ACAGGGCGCTGAGCCCAGAAAGAACTTCGTGAAGCCCAACGAGACTAAGACCTACTTTTGGAAGGTGCAGCACCACATGGCCCCTACAAAGGACGAGT<br>TCGACTGCAAAGCCTGGGCCTACTTCTCCGATGTGGATCTGGAAAAGGACGTGCACAGCGGGCTCATCGGACCACTGCTTGTGTGCCACACCAACACA<br>CTGAACCCCGCTCACGGCAGACAAGTGACAGTGCAAGAGTTCGCCCTGTTCTTCACCATCTTCGACGAAACAAAGAGCTGGTACTTCACCGAGAATAT<br>GGAACGGAACTGCAGAGCCCCTTGCAACATCCAGATGGAAGATCCCACCTTCAAAGAGAACTACCGGTTCCACGCCATCAACGGCTACATCATGGACA<br>CACTGCCCGGCCTGGTTATGGCCCAGGATCAGAGAATCCGGTGGTATCTGCTGTCCATGGGCTCCAACGAGAATATCCACAGCATCCACTTCAGCGGC<br>CACGTGTTCACCGTGCGGAAAAAAGAAGAGTACAAAATGGCCCTGTACAATCTGTACCCTGGGGTGTTCGAAACCGTGGAAATGCTGCCTTCCAAGGC<br>CGGCATTTGGAGAGTGGAATGTCTGATTGGAGAGCACCTCCACGCCGGAATGAGCACCCTGTTTCTGGTGTACAGCAACAAGTGTCAGACCCCTCTCG<br>GCATGGCCTCTGGACACATCAGAGACTTCCAGATCACCGCCTCTGGCCAGTACGGACAGTGGGCTCCTAAACTGGCTCGGCTGCACTACAGCGGCAGC<br>ATCAATGCCTGGTCCACCAAAGAGCCCTTCAGCTGGATCAAGGTGGACCTGCTGGCTCCCATGATCATCCACGGAATCAAGACCCAGGGCGCCAGACA<br>GAAGTTCAGCAGCCTGTACATCAGCCAGTTCATCATCATGTACAGCCTGGACGGCAAGAAGTGGCAGACCTACAGAGGCAACAGCACCGGCACACTCA<br>TGGTGTTCTTCGGCAACGTGGACTCCAGCGGCATTAAGCACAACATCTTCAACCCTCCAATCATTGCCCGGTACATCCGGCTGCACCCCACACACTAC<br>AGCATCCGGTCTACCCTGAGAATGGAACTGATGGGCTGCGACCTGAACAGCTGCTCTATGCCCCTCGGAATGGAAAGCAAGGCCATCAGCGACGCCCA<br>GATCACAGCCAGCAGCTACTTCACCAACATGTTCGCCACTTGGAGCCCCTCCAAGGCTAGACTGCATCTGCAGGGCAGAAGCAACGCTTGGAGGCCCC<br>AAGTGAACAACCCCAAAGAGTGGCTGCAGGTTGACTTTCAAAAGACCATGAAAGTGACCGGCGTGACCACACAGGGCGTCAAGTCTCTGCTGACCTCT<br>ATGTACGTGAAAGAGTTCCTGATCTCCAGCAGCCAGGACGGCCATCAGTGGACCCTGTTTTTCCAGAACGGCAAAGTGAAAGTGTTCCAGGGCAATCA<br>GGACAGCTTCACACCCGTGGTCAATTCTCTGGACCCTCCACTGCTGACCAGATACCTGCGGATTCACCCTCAGTCTTGGGTGCACCAGATCGCTCTGC<br>GGATGGAAGTGCTGGGCTGTGAAGCTCAGGACCTCTACTAGTTAATTAAGAGCATCTTACCGCCATTTATTCCCATATTTGTTCTGTTTTTCTTGATT<br>TGGGTATACATTTAAATGTTAATAAAACAAAATGGTGGGGCAATCATTTACATTTTTAGGGATATGTAATTACTAGTTCAGGTGTATTGCCACAAGAC<br>AAACATGTTAAGAAACTTTCCCGTTATTTACGCTCTGTTCCTGTTAATCAACCTCTGGATTACAAAATTTGTGAAAGATTGACTGATATTCTTAACTA<br>TGTTGCTCCTTTTACGCTGTGTGGATATGCTGCTTTATAGCCTCTGTATCTAGCTATTGCTTCCCGTACGGCTTTCGTTTTCTCCTCCTTGTATAAAT<br>CCTGGTTGCTGTCTCTTTTAGAGGAGTTGTGGCCCGTTGTCCGTCAACGTGGCGTGGTGTGCTCTGTGTTTGCTGACGCAACCCCCACTGGCTGGGGC<br>ATTGCCACCACCTGTCAACTCCTTTCTGGGACTTTCGCTTTCCCCCTCCCGATCGCCACGGCAGAACTCATCGCCGCCTGCCTTGCCCGCTGCTGGAC<br>AGGGGCTAGGTTGCTGGGCACTGATAATTCCGTGGTGTTGTCTGTGCCTTCTAGTTGCCAGCCATCTGTTGTTTGCCCCTCCCCCGTGCCTTCCTTGA<br>CCCTGGAAGGTGCCACTCCCACTGTCCTTTCCTAATAAAATGAGGAAATTGCATCGCATTGTCTGAGTAGGTGTCATTCTATTCTGGGGGGTGGGGTG<br>GGGCAGGACAGCAAGGGGGAGGATTGGGAAGACAATAGCAGGCATGCTGGGGATGCGGTGGGCTCTATGGCTCTAGAGCATGGCTACGTAGATAAGTA<br>GCATGGCGGGTTAATCATTAACTACACCTGCAGGAGGAACCCCTAGTGATGGAGTTGGCCACTCCCTCTCTGCGCGCTCGCTCGCTCACTGAGGCCGG<br>GCGACCAAAGGTCGCCCGACGCCCGGGCGGCCTCAGTGAGCGAGCGAGCGCGCAGCTGCCTGCAGGGGCGCGCCTCGAGCCATGGTGCTAGCAGCTGA<br>TGCATAGCATGCGGTACCGGGAGATGGGGGAGGCTAACTGAAACACGGAAGGAGACAATACCGGAAGGAACCCGCGCTATGACGGCAATAAAAAGACA<br>GAATAAAACGCACGGGTGTTGGGTCGTTTGTTCATAAACGCGGGGTTCGGTCCCAGGGCTGGCACTCTGTCGATACCCCACCGAGACCCCATTGGGAC<br>CAATACGCCCGCGTTTCTTCCTTTTCCCCACCCCAACCCCCAAGTTCGGGTGAAGGCCCAGGGCTCGCAGCCAACGTCGGGGCGGCAAGCCCTGCCAT<br>AGCCACTACGGGTACGTAGGCCAACCACTAGAACTATAGCTAGAGTCCTGGGCGAACAAACGATGCTCGCCTTCCAGAAAACCGAGGATGCGAACCAC |

TABLE 9-continued

| ceDNA Vector Name | Nucleic Acid Sequence |
|---|---|
| | TTCATCCGGGGTCAGCACCACCGGCAAGCGCCGCGACGGCCGAGGTCTACCGATCTCCTGAAGCCAGGGCAGATCCGTGCACAGCACCTTGCCGTAGA<br>AGAACAGCAAGGCCGCCAATGCCTGACGATGCGTGGAGACCGAAACCTTGCGCTCGTTCGCCAGCCAGGACAGAAATGCCTCGACTTCGCTGCTGCCC<br>AAGGTTGCCGGGTGACGCACACCGTGGAAACGGATGAAGGCACGAACCCAGTTGACATAAGCCTGTTCGGTTCGTAAACTGTAATGCAAGTAGCGTAT<br>GCGCTCACGCAACTGGTCCAGAACCTTGACCGAACGCAGCGGTGGTAACGGCGCAGTGGCGGTTTTCATGGCTTGTTATGACTGTTTTTTTGTACAGT<br>CTATGCCTCGGGCATCCAAGCAGCAAGCGCGTTACGCCGTGGGTCGATGTTTGATGTTATGGAGCAGCAACGATGTTACGCAGCAGCAACGATGTTAC<br>GCAGCAGGGCAGTCGCCCTAAAACAAAGTTAGGTGGCTCAAGTATGGGCATCATTCGCACATGTAGGCTCGGCCCTGACCAAGTCAAATCCATGCGGG<br>CTGCTCTTGATCTTTTCGGTCGTGAGTTCGGAGACGTAGCCACCTACTCCCAACATCAGCCGGACTCCGATTACCTCGGGAACTTGCTCCGTAGTAAG<br>ACATTCATCGCGCTTGCTGCCTTCGACCAAGAAGCGGTTGTTGGCGCTCTCGCGGCTTACGTTCTGCCCAGGTTTGAGCAGCCGCGTAGTGAGATCTA<br>TATCTATGATCTCGCAGTCTCCGGCGAGCACCGGAGGCAGGGCATTGCCACCGCGCTCATCAATCTCCTCAAGCATGAGGCCAACGCGCTTGGTGCTT<br>ATGTGATCTACGTGCAAGCAGATTACGGTGACGATCCCGCAGTGGCTCTCTATACAAAGTTGGGCATACGGGAAGAAGTGATGCACTTTGATATCGAC<br>CCAAGTACCGCCACCTAACAATTCGTTCAAGCCGAGATCGGCTTCCCGGCCGCGGAGTTGTTCGGTAAATTGTCACAACGCCGCGAATATAGTCTTTA<br>CCATGCCCTTGGCCACGCCCCTCTTTAATACGACGGGCAATTTGCACTTCAGAAAATGAAGAGTTTGCTTTAGCCATAACAAAAGTCCAGTATGCTTT<br>TTCACAGCATAACTGGACTGATTTCAGTTTACAACTATTCTGTCTAGTTTAAGACTTTATTGTCATAGTTTAGATCTATTTTGTTCAGTTTAAGACTT<br>TATTGTCCGCCCACACCCGCTTACGCAGGGCATCCATTTATTACTCAACCGTAACCGATTTTGCCAGGTTACGCGGCTGGTCTGCGGTGTGAAATACC<br>GCACAGATGCGTAAGGAGAAAATACCGCATCAGGCGCTCTTCCGCTTCCTCGCTCACTGACTCGCTGCGCTCGGTCGTTCGGCTGCGGCGAGCGGTAT<br>CAGCTCACTCAAAGGCGGTAATACGGTTATCCACAGAATCAGGGGATAACGCAGGAAAGAACATGTGAGCAAAAGGCCAGCAAAAGGCCAGGAACCGT<br>AAAAAGGCCGCGTTGCTGGCGTTTTTCCATAGGCTCCGCCCCCCTGACGAGCATCACAAAAATCGACGCTCAAGTCAGAGGTGGCGAAACCCGACAGG<br>ACTATAAAGATACCAGGCGTTTCCCCCTGGAAGCTCCCTCGTGCGCTCTCCTGTTCCGACCCTGCCGCTTACCGGATACCTGTCCGCCTTTCTCCCTT<br>CGGGAAGCGTGGCGCTTTCTCAATGCTCACGCTGTAGGTATCTCAGTTCGGTGTAGGTCGTTCGCTCCAAGCTGGGCTGTGTGCACGAACCCCCCGTT<br>CAGCCCGACCGCTGCGCCTTATCCGGTAACTATCGTCTTGAGTCCAACCCGGTAAGACACGACTTATCGCCACTGGCAGCAGCCACTGGTAACAGGAT<br>TAGCAGAGCGAGGTATGTAGGCGGTGCTACAGAGTTCTTGAAGTGGTGGCCTAACTACGGCTACACTAGAAGGACAGTATTTGGTATCTGCGCTCTGC<br>TGAAGCCAGTTACCTTCGGAAAAAGAGTTGGTAGCTCTTGATCCGGCAAACAAACCACCGCTGGTAGCGGTGGTTTTTTTGTTTGCAAGCAGCAGATT<br>ACGCGCAGAAAAAAAGGATCTCAAGAAGATCCTTTGATCTTTTCTACGGGGTCTGACGCTCAGTGGAACGAAAACTCACGTTAAGGGATTTTGGTCAT<br>GAGATTATCAAAAAGGATCTTCACCTAGATCCTTTTAAATTAAAAATGAAGTTTTAAATCAATCTAAAGTATATATGAGTAAACTTGGTCTGACAGTT<br>ACCAATGCTTAATCAGTGAGGCACCTATCTCAGCGATCTGTCTATTTCGTTCATCCATAGTTGCCTGACTCCCCGTCGTGTAGATAACTACGATACGG<br>GAGGGCTTACCATCTGGCCCCAGTGCTGCAATGATACCGCGAGACCCACGCTCACCGGCTCCAGATTTATCAGCAATAAACCAGCCAGCCGGAAGGGC<br>CGAGCGCAGAAGTGGTCCTGCAACTTTATCCGCCTCCATCCAGTCTATTAATTGTTGCCGGGAAGCTAGAGTAAGTAGTTCGCCAGTTAATAGTTTGC<br>GCAACGTTGTTGCCATTGCTACAGGCATCGTGGTGTCACGCTCGTCGTTTGGTATGGCTTCATTCAGCTCCGGTTCCCAACGATCAAGGCGAGTTACA<br>TGATCCCCCATGTTGTGCAAAAAAGCGGTTAGCTCCTTCGGTCCTCCGATCGTTGTCAGAAGTAAGTTGGCCGCAGTGTTATCACTCATGGTTATGGC<br>AGCACTGCATAATTCTCTTACTGTCATGCCATCCGTAAGATGCTTTTCTGTGACTGGTGAGTACTCAACCAAGTCATTCTGAGAATAGTGTATGCGGC<br>GACCGAGTTGCTCTTGCCCGGCGTCAATACGGGATAATACCGCGCCACATAGCAGAACTTTAAAAGTGCTCATCATTGGAAAACGTTCTTCGGGGCGA<br>AAACTCTCAAGGATCTTACCGCTGTTGAGATCCAGTTCGATGTAACCCACTCGTGCACCCAACTGATCTTCAGCATCTTTTACTTTCACCAGCGTTTC<br>TGGGTGAGCAAAAACAGGAAGGCAAAATGCCGCAAAAAAGGGAATAAGGGCGACACGGAAATGTTGAATACTCATACTCTTCCTTTTTCAATATTATT<br>GAAGCATTTATCAGGGTTATTGTCTCATGAGCGGATACATATTTGAATGTATTTAGAAAAATAAACAAATAGGGGTTCCGCGCACATTTCCCCGAAAA<br>GTGCCACCTGAAATTGTAAACGTTAATATTTTGTTAAAATTCGCGTTAAATTTTTGTTAAATCAGCTCATTTTTTAACCAATAGGCCGAAATCGGCAA<br>AATCCCTTATAAATCAAAAGAATAGACCGAGATAGGGTTGAGTGTTGTTCCAGTTTGGAACAAGAGTCCACTATTAAAGAACGTGGACTCCAACGTCA<br>AAGGGCGAAAAACCGTCTATCAGGGCGATGGCCCACTACGTGAACCATCACCCTAATCAAGTTTTTTGGGGTCGAGGTGCCGTAAAGCACTAAATCGG<br>AACCCTAAAGGGAGCCCCCGATTTAGAGCTTGACGGGGAAAGCCGGCGAACGTGGCGAGAAAGGAAGGGAAGAAAGCGAAAGGAGCGGGCGCTAGGGC<br>GCTGGCAAGTGTAGCGGTCACGCTGCGCGTAACCACCACACCCGCCGCGCTTAATGCGCCGCTACAGGGCGCGTCCCATTCGCCATTCAGGCTGCAAA<br>TAAGCGTTGATATTCAGTCAATTACAAACATTAATAACGAAGAGATGACAGAAAAATTTTCATTCTGTGACAGAGAA |
| ceDNAFVIII-vector 12 (SEQ ID NO: 203) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGAGTTTGCTGCTTGCAATGTTTGCCCATTTTAGGGTGGACACAGGACGCTGTGGTTTCTGAGCCAGGG**GGCGACTCAGATCCCAGCCAGTGGAC**<br>**TTAGCCCCTGTTTGCTCCTCCGATAACTGGGGTGACCTTGGTTAATATTCACCAGCAGCCTCCCCCGTTGCCCCTCTGGATCCACTGCTTAAATACGG**<br>**ACGAGGACAGGGCCCTGTC**TCCTCAGCTTCAGGCACCACCACTGACCTGGGACAGTGAATCGCCACCATGCAGATTGAGCTGAGCACCTGCTTCTTCC<br>TGTGCCTGCTGAGGTTCTGCTTCTCTGCCACCAGGAGATACTACCTGGGGGCTGTGGAGCTGAGCTGGGACTACATGCAGTCTGACCTGGGGGAGCTG<br>CCTGTGGATGCCAGGTTCCCCCCCAGAGTGCCCAAGAGCTTCCCCTTCAACACCTCTGTGGTGTACAAGAAGACCCTGTTTGTGGAGTTCACTGACCA<br>CCTGTTCAACATTGCCAAGCCCAGGCCCCCCTGGATGGGCCTGCTGGGCCCCACCATCCAGGCTGAGGTGTATGACACTGTGGTGATCACCCTGAAGA<br>ACATGGCCAGCCACCCTGTGAGCCTGCATGCTGTGGGGGTGAGCTACTGGAAGGCCTCTGAGGGGGCTGAGTATGATGACCAGACCAGCCAGAGGGAG |

TABLE 9-continued

| ceDNA Vector Name | Nucleic Acid Sequence |
|---|---|
| | AAGGAGGATGACAAGGTGTTCCCTGGGGGCAGCCACACCTATGTGTGGCAGGTGCTGAAGGAGAATGGCCCCATGGCCTCTGACCCCCTGTGCCTGAC |
| | CTACAGCTACCTGAGCCATGTGGACCTGGTGAAGGACCTGAACTCTGGCCTGATTGGGGCCCTGCTGGTGTGCAGGGAGGGCAGCCTGGCCAAGGAGA |
| | AGACCCAGACCCTGCACAAGTTCATCCTGCTGTTTGCTGTGTTTGATGAGGGCAAGAGCTGGCACTCTGAAACCAAGAACAGCCTGATGCAGGACAGG |
| | GATGCTGCCTCTGCCAGGGCCTGGCCCAAGATGCACACTGTGAATGGCTATGTGAACAGGAGCCTGCCTGGCCTGATTGGCTGCCACAGGAAGTCTGT |
| | GTACTGGCATGTGATTGGCATGGGCACCACCCCTGAGGTGCACAGCATCTTCCTGGAGGGCCACACCTTCCTGGTCAGGAACCACAGGCAGGCCAGCC |
| | TGGAGATCAGCCCCATCACCTTCCTGACTGCCCAGACCCTGCTGATGGACCTGGGCCAGTTCCTGCTGTTCTGCCACATCAGCAGCCACCAGCATGAT |
| | GGCATGGAGGCCTATGTGAAGGTGGACAGCTGCCCTGAGGAGCCCCAGCTGAGGATGAAGAACAATGAGGAGGCTGAGGACTATGATGATGACCTGAC |
| | TGACTCTGAGATGGATGTGGTGAGGTTTGATGATGACAACAGCCCCAGCTTCATCCAGATCAGGTCTGTGGCCAAGAAGCACCCCAAGACCTGGGTGC |
| | ACTACATTGCTGCTGAGGAGGAGGACTGGGACTATGCCCCCCTGGTGCTGGCCCCTGATGACAGGAGCTACAAGAGCCAGTACCTGAACAATGGCCCC |
| | CAGAGGATTGGCAGGAAGTACAAGAAGGTCAGGTTCATGGCCTACACTGATGAAACCTTCAAGACCAGGGAGGCCATCCAGCATGAGTCTGGCATCCT |
| | GGGCCCCCTGCTGTATGGGGAGGTGGGGGACACCCTGCTGATCATCTTCAAGAACCAGGCCAGCAGGCCCTACAACATCTACCCCCATGGCATCACTG |
| | ATGTGAGGCCCCTGTACAGCAGGAGGCTGCCCAAGGGGGTGAAGCACCTGAAGGACTTCCCCATCCTGCCTGGGGAGATCTTCAAGTACAAGTGGACT |
| | GTGACTGTGGAGGATGGCCCCACCAAGTCTGACCCCAGGTGCCTGACCAGATACTACAGCAGCTTTGTGAACATGGAGAGGGACCTGGCCTCTGGCCT |
| | GATTGGCCCCCTGCTGATCTGCTACAAGGAGTCTGTGGACCAGAGGGGCAACCAGATCATGTCTGACAAGAGGAATGTGATCCTGTTCTCTGTGTTTG |
| | ATGAGAACAGGAGCTGGTACCTGACTGAGAACATCCAGAGGTTCCTGCCCAACCCTGCTGGGGTGCAGCTGGAGGACCCTGAGTTCCAGGCCAGCAAC |
| | ATCATGCACAGCATCAATGGCTATGTGTTTGACAGCCTGCAGCTGTCTGTGTGCCTGCATGAGGTGGCCTACTGGTACATCCTGAGCATTGGGGCCCA |
| | GACTGACTTCCTGTCTGTGTTCTTCTCTGGCTACACCTTCAAGCACAAGATGGTGTATGAGGACACCCTGACCCTGTTCCCCTTCTCTGGGGAGACTG |
| | TGTTCATGAGCATGGAGAACCCTGGCCTGTGGATTCTGGGCTGCCACAACTCTGACTTCAGGAACAGGGGCATGACTGCCCTGCTGAAAGTCTCCAGC |
| | TGTGACAAGAACACTGGGGACTACTATGAGGACAGCTATGAGGACATCTCTGCCTACCTGCTGAGCAAGAACAATGCCATTGAGCCCAGGAGCTTCAG |
| | CCAGAACCCCCCAGTGCTGAAGAGGCACCAGAGGGAGATCACCAGGACCACCCTGCAGTCTGACCAGGAGGAGATTGACTATGATGACACCATCTCTG |
| | TGGAGATGAAGAAGGAGGACTTTGACATCTACGACGAGGACGAGAACCAGAGCCCCAGGAGCTTCCAGAAGAAGACCAGGCACTACTTCATTGCTGCT |
| | GTGGAGAGGCTGTGGGACTATGGCATGAGCAGCAGCCCCCATGTGCTGAGGAACAGGGCCCAGTCTGGCTCTGTGCCCCAGTTCAAGAAGGTGGTGTT |
| | CCAGGAGTTCACTGATGGCAGCTTCACCCAGCCCCTGTACAGAGGGGAGCTGAATGAGCACCTGGGCCTGCTGGGCCCCTACATCAGGGCTGAGGTGG |
| | AGGACAACATCATGGTGACCTTCAGGAACCAGGCCAGCAGGCCCTACAGCTTCTACAGCAGCCTGATCAGCTATGAGGAGGACCAGAGGCAGGGGGCT |
| | GAGCCCAGGAAGAACTTTGTGAAGCCCAATGAAACCAAGACCTACTTCTGGAAGGTGCAGCACCACATGGCCCCCACCAAGGATGAGTTTGACTGCAA |
| | GGCCTGGGCCTACTTCTCTGATGTGGACCTGGAGAAGGATGTGCACTCTGGCCTGATTGGCCCCCTGCTGGTGTGCCACACCAACACCCTGAACCCTG |
| | CCCATGGCAGGCAGGTGACTGTGCAGGAGTTTGCCCTGTTCTTCACCATCTTTGATGAAACCAAGAGCTGGTACTTCACTGAGAACATGGAGAGGAAC |
| | TGCAGGGCCCCCTGCAACATCCAGATGGAGGACCCCACCTTCAAGGAGAACTACAGGTTCCATGCCATCAATGGCTACATCATGGACACCCTGCCTGG |
| | CCTGGTGATGGCCCAGGACCAGAGGATCAGGTGGTACCTGCTGAGCATGGGCAGCAATGAGAACATCCACAGCATCCACTTCTCTGGCCATGTGTTCA |
| | CTGTGAGGAAGAAGGAGGAGTACAAGATGGCCCTGTACAACCTGTACCCTGGGGTGTTTGAGACTGTGGAGATGCTGCCCAGCAAGGCTGGCATCTGG |
| | AGGGTGGAGTGCCTGATTGGGGAGCACCTGCATGCTGGCATGAGCACCCTGTTCCTGGTGTACAGCAACAAGTGCCAGACCCCCCTGGGCATGGCCTC |
| | TGGCCACATCAGGGACTTCCAGATCACTGCCTCTGGCCAGTATGGCCAGTGGGCCCCCAAGCTGGCCAGGCTGCACTACTCTGGCAGCATCAATGCCT |
| | GGAGCACCAAGGAGCCCTTCAGCTGGATCAAGGTGGACCTGCTGGCCCCCATGATCATCCATGGCATCAAGACCCAGGGGGCCAGGCAGAAGTTCAGC |
| | AGCCTGTACATCAGCCAGTTCATCATCATGTACAGCCTGGATGGCAAGAAGTGGCAGACCTACAGGGGCAACAGCACTGGCACCCTGATGGTGTTCTT |
| | TGGCAATGTGGACAGCTCTGGCATCAAGCACAACATCTTCAACCCCCCCATCATTGCCAGATACATCAGGCTGCACCCCACCCACTACAGCATCAGGA |
| | GCACCCTGAGGATGGAGCTGATGGGCTGTGACCTGAACAGCTGCAGCATGCCCCTGGGCATGGAGAGCAAGGCCATCTCTGATGCCCAGATCACTGCC |
| | AGCAGCTACTTCACCAACATGTTTGCCACCTGGAGCCCCAGCAAGGCCAGGCTGCACCTGCAGGGCAGGAGCAATGCCTGGAGGCCCCAGGTCAACAA |
| | CCCCAAGGAGTGGCTGCAGGTGGACTTCCAGAAGACCATGAAGGTGACTGGGGTGACCACCCAGGGGGTGAAGAGCCTGCTGACCAGCATGTATGTGA |
| | AGGAGTTCCTGATCAGCAGCAGCCAGGATGGCCACCAGTGGACCCTGTTCTTCCAGAATGGCAAGGTGAAGGTGTTCCAGGGCAACCAGGACAGCTTC |
| | ACCCCTGTGGTGAACAGCCTGGACCCCCCCCTGCTGACCAGATACCTGAGGATTCACCCCCAGAGCTGGGTGCACCAGATTGCCCTGAGGATGGAGGT |
| | GCTGGGCTGTGAGGCCCAGGACCTGTACTGAAATAAAAGATCTTTATTTTCATTAGATCTGTGTGTTGGTTTTTTGTGTGTCTAGAGCATGGCTACGT |
| | AGATAAGTAGCATGGCGGGTTAATCATTAACTACACCTGCAGGAGGAACCCCTAGTGATGGAGTTGGCCACTCCCTCTCTGCGCGCTCGCTCGCTCAC |
| | TGAGGCCGGGCGACCAAAGGTCGCCCGACGCCCGGGCGGCCTCAGTGAGCGAGCGAGCGCGCAGCTGCCTGCAGGGGCGCGCCTCGAGGCATGCGGTA |
| | CCAAGCTTGTCGAGAAGTACTAGAGGATCATAATCAGCCATACCACATTTGTAGAGGTTTTACTTGCTTTAAAAAACCTCCCACACCTCCCCCTGAAC |
| | CTGAAACATAAAATGAATGCAATTGTTGTTGTTAACTTGTTTATTGCAGCTTATAATGGTTACAAATAAAGCAATAGCATCACAAATTTCACAAATAA |
| | AGCATTTTTTTCACTGCATTCTAGTTGTGGTTTGTCCAAACTCATCAATGTATCTTATCATGTCTGGATCTGATCACTGATATCGCCTAGGAGATCCG |
| | AACCAGATAAGTGAAATCTAGTTCCAAACTATTTTGTCATTTTTAATTTTCGTATTAGCTTACGACGCTACACCCAGTTCCCATCTATTTTGTCACTC |
| | TTCCCTAAATAATCCTTAAAAACTCCATTTCCACCCCTCCCAGTTCCCAACTATTTTGTCCGCCCACAGCGGGGCATTTTTCTTCCTGTTATGTTTTT |
| | AATCAAACATCCTGCCAACTCCATGTGACAAACCGTCATCTTCGGCTACTTTTTCTCTGTCACAGAATGAAAATTTTTCTGTCATCTCTTCGTTATTA |
| | ATGTTTGTAATTGACTGAATATCAACGCTTATTTGCAGCCTGAATGGCGAATGGGACGCGCCCTGTAGCGGCGCATTAAGCGCGGCGGGTGTGGTGGT |

TABLE 9-continued

| ceDNA Vector Name | Nucleic Acid Sequence |
|---|---|
| | TACGCGCAGCGTGACCGCTACACTTGCCAGCGCCCTAGCGCCCGCTCCTTTCGCTTTCTTCCCTTCCTTTCTCGCCACGTTCGCCGGCTTTCCCCGTC<br>AAGCTCTAAATCGGGGGCTCCCTTTAGGGTTCCGATTTAGTGCTTTACGGCACCTCGACCCCAAAAAACTTGATTAGGGTGATGGTTCACGTAGTGGG<br>CCATCGCCCTGATAGACGGTTTTTCGCCCTTTGACGTTGGAGTCCACGTTCTTTAATAGTGGACTCTTGTTCCAAACTGGAACAACACTCAACCCTAT<br>CTCGGTCTATTCTTTTGATTTATAAGGGATTTTGCCGATTTCGGCCTATTGGTTAAAAAATGAGCTGATTTAACAAAAATTTAACGCGAATTTTAACA<br>AAATATTAACGTTTACAATTTCAGGTGGCACTTTTCGGGGAAATGTGCGCGGAACCCCTATTTGTTTATTTTTCTAAATACATTCAAATATGTATCCG<br>CTCATGAGACAATAACCCTGATAAATGCTTCAATAATATTGAAAAAGGAAGAGTATGAGTATTCAACATTTCCGTGTCGCCCTTATTCCCTTTTTTGC<br>GGCATTTTGCCTTCCTGTTTTTGCTCACCCAGAAACGCTGGTGAAAGTAAAAGATGCTGAAGATCAGTTGGGTGCACGAGTGGGTTACATCGAACTGG<br>ATCTCAACAGCGGTAAGATCCTTGAGAGTTTTCGCCCCGAAGAACGTTTTCCAATGATGAGCACTTTTAAAGTTCTGCTATGTGGCGCGGTATTATCC<br>CGTATTGACGCCGGGCAAGAGCAACTCGGTCGCCGCATACACTATTCTCAGAATGACTTGGTTGAGTACTCACCAGTCACAGAAAAGCATCTTACGGA<br>TGGCATGACAGTAAGAGAATTATGCAGTGCTGCCATAACCATGAGTGATAACACTGCGGCCAACTTACTTCTGACAACGATCGGAGGACCGAAGGAGC<br>TAACCGCTTTTTTGCACAACATGGGGGATCATGTAACTCGCCTTGATCGTTGGGAACCGGAGCTGAATGAAGCCATACCAAACGACGAGCGTGACACC<br>ACGATGCCTGTAGCAATGGCAACAACGTTGCGCAAACTATTAACTGGCGAACTACTTACTCTAGCTTCCCGGCAACAATTAATAGACTGGATGGAGGC<br>GGATAAAGTTGCAGGACCACTTCTGCGCTCGGCCCTTCCGGCTGGCTGGTTTATTGCTGATAAATCTGGAGCCGGTGAGCGTGGGTCTCGCGGTATCA<br>TTGCAGCACTGGGGCCAGATGGTAAGCCCTCCCGTATCGTAGTTATCTACACGACGGGGAGTCAGGCAACTATGGATGAACGAAATAGACAGATCGCT<br>GAGATAGGTGCCTCACTGATTAAGCATTGGTAACTGTCAGACCAAGTTTACTCATATATACTTTAGATTGATTTAAAACTTCATTTTTAATTTAAAAG<br>GATCTAGGTGAAGATCCTTTTTGATAATCTCATGACCAAAATCCCTTAACGTGAGTTTTCGTTCCACTGAGCGTCAGACCCCGTAGAAAAGATCAAAG<br>GATCTTCTTGAGATCCTTTTTTTCTGCGCGTAATCTGCTGCTTGCAAACAAAAAAACCACCGCTACCAGCGGTGGTTTGTTTGCCGGATCAAGAGCTA<br>CCAACTCTTTTTCCGAAGGTAACTGGCTTCAGCAGAGCGCAGATACCAAATACTGTCCTTCTAGTGTAGCCGTAGTTAGGCCACCACTTCAAGAACTC<br>TGTAGCACCGCCTACATACCTCGCTCTGCTAATCCTGTTACCAGTGGCTGCTGCCAGTGGCGATAAGTCGTGTCTTACCGGGTTGGACTCAAGACGAT<br>AGTTACCGGATAAGGCGCAGCGGTCGGGCTGAACGGGGGGTTCGTGCACACAGCCCAGCTTGGAGCGAACGACCTACACCGAACTGAGATACCTACAG<br>CGTGAGCATTGAGAAAGCGCCACGCTTCCCGAAGGGAGAAAGGCGGACAGGTATCCGGTAAGCGGCAGGGTCGGAACAGGAGAGCGCACGAGGGAGCT<br>TCCAGGGGGAAACGCCTGGTATCTTTATAGTCCTGTCGGGTTTCGCCACCTCTGACTTGAGCGTCGATTTTTGTGATGCTCGTCAGGGGGGCGGAGCC<br>TATGGAAAAACGCCAGCAACGCGGCCTTTTTACGGTTCCTGGCCTTTTGCTGGCCTTTTGCTCACATGTTCTTTCCTGCGTTATCCCCTGATTCTGTG<br>GATAACCGTATTACCGCCTTTGAGTGAGCTGATACCGCTCGCCGCAGCCGAACGACCGAGCGCAGCGAGTCAGTGAGCGAGGAAGCGGAAGAGCGCCT<br>GATGCGGTATTTTCTCCTTACGCATCTGTGCGGTATTTCACACCGCAGACCAGCCGCGTAACCTGGCAAAATCGGTTACGGTTGAGTAATAAATGGAT<br>GCCCTGCGTAAGCGGGTGTGGGCGGACAATAAAGTCTTAAACTGAACAAAATAGATCTAAACTATGACAATAAAGTCTTAAACTAGACAGAATAGTTG<br>TAAACTGAAATCAGTCCAGTTATGCTGTGAAAAAGCATACTGGACTTTTGTTATGGCTAAAGCAAACTCTTCATTTTCTGAAGTGCAAATTGCCCGTC<br>GTATTAAAGAGGGGCGTGGCCAAGGGCATGGTAAAGACTATATTCGCGGCGTTGTGACAATTTACCGAACAACTCCGCGGCCGGGAAGCCGATCTCGG<br>CTTGAACGAATTGTTAGGTGGCGGTACTTGGGTCGATATCAAAGTGCATCACTTCTTCCCGTATGCCCAACTTTGTATAGAGAGCCACTGCGGGATCG<br>TCACCGTAATCTGCTTGCACGTAGATCACATAAGCACCAAGCGCGTTGGCCTCATGCTTGAGGAGATTGATGAGCGCGGTGGCAATGCCCTGCCTCCG<br>GTGCTCGCCGGAGACTGCGAGATCATAGATATAGATCTCACTACGCGGCTGCTCAAACCTGGGCAGAACGTAAGCCGCGAGAGCGCCAACAACCGCTT<br>CTTGGTCGAAGGCAGCAAGCGCGATGAATGTCTTACTACGGAGCAAGTTCCCGAGGTAATCGGAGTCCGGCTGATGTTGGGAGTAGGTGGCTACGTCT<br>CCGAACTCACGACCGAAAAGATCAAGAGCAGCCCGCATGGATTTGACTTGGTCAGGGCCGAGCCTACATGTGCGAATGATGCCCATACTTGAGCCACC<br>TAACTTTGTTTTAGGGCGACTGCCCTGCTGCGTAACATCGTTGCTGCTGCGTAACATCGTTGCTGCTCCATAACATCAAACATCGACCCACGGCGTAA<br>CGCGCTTGCTGCTTGGATGCCCGAGGCATAGACTGTACAAAAAAACAGTCATAACAAGCCATGAAAACCGCCACTGCGCCGTTACCACCGCTGCGTTC<br>GGTCAAGGTTCTGGACCAGTTGCGTGAGCGCATACGCTACTTGCATTACAGTTTACGAACCGAACAGGCTTATGTCAACTGGGTTCGTGCCTTCATCC<br>GTTTCCACGGTGTGCGTCACCCGGCAACCTTGGGCAGCAGCGAAGTCGAGGCATTTCTGTCCTGGCTGGCGAACGAGCGCAAGGTTTCGGTCTCCACG<br>CATCGTCAGGCATTGGCGGCCTTGCTGTTCTTCTACGGCAAGGTGCTGTGCACGGATCTGCCCTGGCTTCAGGAGATCGGAAGACCTCGGCCGTCGCG<br>GCGCTTGCCGGTGGTGCTGACCCCGGATGAAGTGGTTCGCATCCTCGGTTTTCTGGAAGGCGAGCATCGTTTGTTCGCCCAGGACTCTAGCTATAGTT<br>CTAGTGGTTGGCTACGTATACTCCGGAATATTAATAGATCATGGAGATAATTAAAATGATAACCATCTCGCAAATAAATAAGTATTTTACTGTTTTCG<br>TAACAGTTTTGTAATAAAAAAACCTATAAATATTCCGGATTATTCATACCGTCCCACCATCGGGCGCGGATCTCGGTCCGAAACCATGTCGTACTACC<br>ATCACCATCACCATCACGATTACGATATCCCAACGACCGAAAACCTGTATTTTCAGGGCGCCATGGGATCC |
| ceDNAFVIII-vector 13 (SEQ ID NO: 204) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGA**GTCTGTCTGCACATTTCGTAGAGCGAGTGTTCCGATACTCTAATCTCCCTAGGCAAGGTTCATATTGACTTAGGTTACTTATTCTCCTTTTG**<br>**TTGACTAAGTCAATAATCAGAATCAGCAGGTTTGGAGTCAGCTTGGCAGGGATCAGCAGCCTGGGTTGGAAGGAGGGGGTATAAAAGCCCCTTCACCA**<br>**GGAGAAGCCGTCACACAGATCCACAAGCTCCT**GCTAGCAGGTAAGTGCCGTGTGTGGTTCCCGCGGGCCTGGCCTCTTTACGGGTTATGGCCCTTGCG<br>TGCCTTGAATTACTGACACTGACATCCACTTTTTCTTTTTCTCCACAGGTTTAAACGCCACCATGCAGATTGAGCTGAGCACCTGCTTCTTCCTGTGT<br>CTGCTGAGGTTCTGCTTCTCTGCCACCAGGAGGTATTACCTGGGGGCTGTGGAGCTGAGCTGGGACTATATGCAGTCTGACCTGGGGGAGCTGCCTGT |

TABLE 9-continued

| ceDNA Vector Name | Nucleic Acid Sequence |
|---|---|
| | GGATGCTAGGTTCCCCCCCAGGGTGCCCAAGAGCTTCCCCTTTAACACTTCTGTGGTGTACAAGAAGACCCTGTTTGTGGAGTTCACTGACCACCTGT |
| | TCAACATTGCCAAGCCCAGGCCCCCCTGGATGGGGCTGCTGGGGCCCACCATCCAGGCTGAGGTGTATGACACTGTGGTGATCACCCTGAAGAACATG |
| | GCCAGCCACCCTGTGAGCCTGCATGCTGTGGGGGTGAGCTACTGGAAGGCTTCTGAGGGGGCTGAGTATGATGACCAGACTAGCCAGAGGGAGAAGGA |
| | GGATGACAAGGTGTTTCCTGGGGGCAGCCATACCTATGTGTGGCAGGTGCTGAAGGAGAATGGCCCCATGGCCTCTGACCCCCTGTGCCTGACCTACA |
| | GCTACCTGTCTCATGTGGACCTGGTGAAGGACCTGAACTCTGGCCTGATTGGGGCTCTGCTGGTGTGTAGGGAGGGCAGCCTGGCTAAGGAAAAGACC |
| | CAGACCCTGCATAAGTTTATCCTGCTGTTTGCTGTGTTTGATGAGGGCAAGAGCTGGCACTCTGAGACCAAGAACAGCCTGATGCAGGATAGGGATGC |
| | TGCCTCTGCCAGGGCTTGGCCTAAGATGCACACTGTGAATGGGTATGTGAATAGGAGCCTGCCTGGCCTGATTGGCTGCCACAGGAAGTCTGTGTACT |
| | GGCATGTGATTGGGATGGGCACCACCCCTGAGGTCCATAGCATCTTCCTGGAGGGCCACACTTTCCTGGTGAGGAACCACAGACAGGCCTCTCTGGAG |
| | ATCTCTCCCATCACCTTCCTGACTGCTCAGACTCTGCTGATGGACCTGGGCCAGTTCCTGCTGTTTTGCCATATTAGCAGCCACCAGCATGATGGGAT |
| | GGAGGCCTATGTGAAGGTGGATAGCTGCCCTGAGGAGCCTCAGCTGAGGATGAAGAACAATGAGGAGGCTGAAGACTATGATGATGACCTGACTGATT |
| | CTGAGATGGATGTGGTGAGGTTTGATGATGACAATAGCCCCAGCTTCATTCAGATCAGGTCTGTGGCCAAGAAACACCCCAAGACCTGGGTGCACTAC |
| | ATTGCTGCTGAGGAAGAGGACTGGGACTATGCTCCCCTGGTGCTGGCCCCTGATGATAGGTCTTATAAGAGCCAGTACCTGAACAATGGGCCCCAGAG |
| | GATTGGCAGGAAGTACAAGAAGGTGAGGTTCATGGCCTACACTGATGAAACCTTCAAAACCAGGGAGGCCATTCAGCATGAGTCTGGCATCCTGGGCC |
| | CTCTGCTGTATGGGGAGGTGGGGGACACCCTGCTGATCATCTTCAAGAACCAGGCCAGCAGGCCCTACAACATCTATCCTCATGGCATCACTGATGTG |
| | AGGCCCCTGTACAGCAGGAGGCTGCCCAAGGGGGTGAAGCACCTGAAAGACTTCCCCATCCTGCCTGGGGAGATCTTTAAGTATAAGTGGACTGTGAC |
| | TGTGGAGGATGGCCCTACCAAGTCTGACCCCAGGTGTCTGACCAGGTACTATTCTAGCTTTGTGAACATGGAGAGGGACCTGGCCTCTGGCCTGATTG |
| | GGCCCCTGCTGATCTGCTACAAGGAGTCTGTGGACCAGAGGGGCAACCAGATCATGTCTGACAAGAGGAATGTGATCCTGTTTTCTGTGTTTGATGAG |
| | AATAGGAGCTGGTACCTGACTGAGAACATCCAGAGGTTTCTGCCCAATCCTGCTGGGGTGCAGCTGGAGGATCCTGAGTTCCAGGCCAGCAATATCAT |
| | GCATAGCATCAATGGCTATGTGTTTGACAGCCTGCAGCTGTCTGTGTGCCTGCATGAGGTGGCCTACTGGTACATCCTGAGCATTGGGGCCCAGACTG |
| | ACTTTCTGTCTGTGTTCTTTTCTGGCTATACCTTCAAGCACAAGATGGTGTATGAGGATACCCTGACCCTGTTCCCCTTCTCTGGGGAGACTGTGTTC |
| | ATGAGCATGGAGAATCCTGGGCTGTGGATCCTGGGGTGCCACAACTCTGATTTTAGGAACAGGGGGATGACTGCCCTGCTGAAGGTGTCTAGCTGTGA |
| | TAAGAACACTGGGGACTACTATGAGGACAGCTATGAGGACATTTCTGCTTATCTGCTGTCTAAGAATAATGCCATTGAGCCCAGAAGCTTCAGCCAGA |
| | ATCCCCCTGTGCTGAAGAGACATCAGAGGGAGATCACCAGAACTACCCTGCAGTCTGATCAGGAGGAGATTGACTATGATGACACTATCTCTGTGGAG |
| | ATGAAGAAGGAGGACTTTGACATCTATGATGAGGATGAGAATCAGTCTCCCAGGAGCTTTCAGAAGAAGACCAGACATTACTTCATTGCTGCTGTGGA |
| | GAGGCTGTGGGACTATGGCATGAGCTCTAGCCCTCATGTGCTGAGGAACAGGGCCCAGTCTGGCTCTGTGCCCCAGTTCAAGAAGGTGGTGTTCCAGG |
| | AATTCACTGATGGCAGCTTCACCCAGCCCCTGTACAGGGGGGAGCTGAATGAGCACCTGGGCCTGCTGGGGCCTTATATCAGGGCTGAGGTGGAGGAT |
| | AATATTATGGTGACTTTCAGGAACCAGGCCAGCAGGCCCTACTCTTTCTATAGCAGCCTGATCTCTTATGAGGAGGATCAGAGGCAGGGGGCTGAGCC |
| | TAGGAAGAACTTTGTGAAGCCCAATGAGACTAAGACCTACTTCTGGAAGGTCCAGCACCACATGGCCCCTACCAAGGATGAGTTTGACTGCAAGGCCT |
| | GGGCCTATTTCTCTGATGTGGATCTGGAGAAGGATGTCCATTCTGGGCTGATTGGCCCCCTGCTGGTGTGCCACACTAACACTCTGAATCCTGCCCAT |
| | GGCAGGCAGGTGACTGTCCAGGAGTTTGCCCTGTTCTTCACTATCTTTGATGAGACCAAGAGCTGGTACTTTACTGAGAACATGGAGAGGAACTGCAG |
| | AGCTCCTTGCAATATTCAGATGGAGGACCCCACCTTCAAGGAGAATTACAGGTTCCATGCCATTAATGGGTACATCATGGACACCCTGCCTGGCCTGG |
| | TGATGGCTCAGGACCAGAGGATCAGGTGGTACCTGCTGAGCATGGGCTCTAATGAGAATATCCACAGCATCCACTTCTCTGGGCATGTGTTCACTGTG |
| | AGGAAGAAGGAGGAGTACAAGATGGCTCTGTATAATCTGTACCCTGGGGTGTTTGAAACTGTGGAGATGCTGCCCTCTAAGGCTGGCATCTGGAGGGT |
| | GGAGTGCCTGATTGGGGAGCACCTGCATGCTGGCATGAGCACCCTGTTCCTGGTGTACAGCAACAAGTGCCAGACCCCCCTGGGCATGGCCTCTGGCC |
| | ACATCAGGGACTTCCAGATCACTGCCTCTGGCCAGTATGGCCAGTGGGCCCCCAAGCTGGCCAGGCTGCACTATTCTGGCAGCATCAATGCCTGGAGC |
| | ACCAAGGAGCCCTTCAGCTGGATCAAGGTGGACCTGCTGGCCCCCATGATCATTCATGGCATCAAGACCCAGGGGGCCAGGCAGAAGTTCAGCTCTCT |
| | GTACATCTCTCAGTTCATCATCATGTACTCTCTGGATGGGAAGAAGTGGCAGACCTACAGGGGCAACAGCACTGGCACCCTGATGGTGTTCTTTGGGA |
| | ATGTGGACTCTTCTGGCATCAAGCACAACATCTTCAATCCCCCCATCATTGCTAGGTATATTAGGCTGCATCCCACCCACTACAGCATCAGGTCTACC |
| | CTGAGGATGGAGCTGATGGGCTGTGACCTGAACTCTTGCAGCATGCCCCTGGGCATGGAGTCTAAGGCCATCTCTGATGCCCAGATTACTGCCAGCAG |
| | CTACTTCACCAACATGTTTGCCACCTGGAGCCCCTCTAAGGCCAGGCTGCATCTGCAGGGGAGGAGCAATGCCTGGAGGCCTCAGGTGAACAACCCCA |
| | AGGAGTGGCTGCAGGTGGATTTCCAGAAGACCATGAAGGTGACTGGGGTGACCACCCAGGGGGTCAAGAGCCTGCTGACCAGCATGTATGTGAAGGAG |
| | TTCCTGATCAGCAGCAGCCAGGATGGCCACCAGTGGACTCTGTTCTTTCAGAATGGGAAGGTGAAGGTGTTTCAGGGCAATCAGGACTCTTTCACCCC |
| | TGTGGTGAACAGCCTGGACCCCCCCCTGCTGACCAGATACCTGAGGATCCACCCCCAGTCTTGGGTGCATCAGATTGCCCTGAGGATGGAGGTGCTGG |
| | GCTGTGAGGCTCAGGATCTGTACTGAGCGGCCGCAATAAAAGATCAGAGCTCTAGAGATCTGTGTGTTGGTTTTTTGTGTTCTAGAGCATGGCTACGT |
| | AGATAAGTAGCATGGCGGGTTAATCATTAACTACACCTGCAGGAGGAACCCCTAGTGATGGAGTTGGCCACTCCCTCTCTGCGCGCTCGCTCGCTCAC |
| | TGAGGCCGGGCGACCAAAGGTCGCCCGACGCCCGGGCGGCCTCAGTGAGCGAGCGAGCGCGCAGCTGCCTGCAGGGGCGCGCCTCGAGGCATGCGGTA |
| | CCAAGCTTGTCGAGAAGTACTAGAGGATCATAATCAGCCATACCACATTTGTAGAGGTTTTACTTGCTTTAAAAAACCTCCCACACCTCCCCCTGAAC |
| | CTGAAACATAAAATGAATGCAATTGTTGTTGTTAACTTGTTTATTGCAGCTTATAATGGTTACAAATAAAGCAATAGCATCACAAATTTCACAAATAA |
| | AGCATTTTTTTCACTGCATTCTAGTTGTGGTTTGTCCAAACTCATCAATGTATCTTATCATGTCTGGATCTGATCACTGATATCGCCTAGGAGATCCG |
| | AACCAGATAAGTGAAATCTAGTTCCAAACTATTTTGTCATTTTTAATTTTCGTATTAGCTTACGACGCTACACCCAGTTCCCATCTATTTTGTCACTC |

TABLE 9-continued

| ceDNA Vector Name | Nucleic Acid Sequence |
|---|---|
| | TTCCCTAAATAATCCTTAAAAACTCCATTTCCACCCCTCCCAGTTCCCAACTATTTTGTCCGCCCACAGCGGGGCATTTTTCTTCCTGTTATGTTTTT<br>AATCAAACATCCTGCCAACTCCATGTGACAAACCGTCATCTTCGGCTACTTTTTCTCTGTCACAGAATGAAAATTTTTCTGTCATCTCTTCGTTATTA<br>ATGTTTGTAATTGACTGAATATCAACGCTTATTTGCAGCCTGAATGGCGAATGGACGCGCCCTGTAGCGGCGCATTAAGCGCGGCGGGTGTGGTGGT<br>TACGCGCAGCGTGACCGCTACACTTGCCAGCGCCCTAGCGCCCGCTCCTTTCGCTTTCTTCCCTTCCTTTCTCGCCACGTTCGCCGGCTTTCCCCGTC<br>AAGCTCTAAATCGGGGGCTCCCTTTAGGGTTCCGATTTAGTGCTTTACGGCACCTCGACCCCAAAAAACTTGATTAGGGTGATGGTTCACGTAGTGGG<br>CCATCGCCCTGATAGACGGTTTTTCGCCCTTTGACGTTGGAGTCCACGTTCTTTAATAGTGGACTCTTGTTCCAAACTGGAACAACACTCAACCCTAT<br>CTCGGTCTATTCTTTTGATTTATAAGGGATTTTGCCGATTTCGGCCTATTGGTTAAAAAATGAGCTGATTTAACAAAAATTTAACGCGAATTTTAACA<br>AAATATTAACGTTTACAATTTCAGGTGGCACTTTTCGGGGAAATGTGCGCGGAACCCCTATTTGTTTATTTTTCTAAATACATTCAAATATGTATCCG<br>CTCATGAGACAATAACCCTGATAAATGCTTCAATAATATTGAAAAAGGAAGAGTATGAGTATTCAACATTTCCGTGTCGCCCTTATTCCCTTTTTTGC<br>GGCATTTTGCCTTCCTGTTTTTGCTCACCCAGAAACGCTGGTGAAAGTAAAAGATGCTGAAGATCAGTTGGGTGCACGAGTGGGTTACATCGAACTGG<br>ATCTCAACAGCGGTAAGATCCTTGAGAGTTTTCGCCCCGAAGAACGTTTTCCAATGATGAGCACTTTTAAAGTTCTGCTATGTGGCGCGGTATTATCC<br>CGTATTGACGCCGGGCAAGAGCAACTCGGTCGCCGCATACACTATTCTCAGAATGACTTGGTTGAGTACTCACCAGTCACAGAAAAGCATCTTACGGA<br>TGGCATGACAGTAAGAGAATTATGCAGTGCTGCCATAACCATGAGTGATAACACTGCGGCCAACTTACTTCTGACAACGATCGGAGGACCGAAGGAGC<br>TAACCGCTTTTTTGCACAACATGGGGGATCATGTAACTCGCCTTGATCGTTGGGAACCGGAGCTGAATGAAGCCATACCAAACGACGAGCGTGACACC<br>ACGATGCCTGTAGCAATGGCAACAACGTTGCGCAAACTATTAACTGGCGAACTACTTACTCTAGCTTCCCGGCAACAATTAATAGACTGGATGGAGGC<br>GGATAAAGTTGCAGGACCACTTCTGCGCTCGGCCCTTCCGGCTGGCTGGTTTATTGCTGATAAATCTGGAGCCGGTGAGCGTGGGTCTCGCGGTATCA<br>TTGCAGCACTGGGGCCAGATGGTAAGCCCTCCCGTATCGTAGTTATCTACACGACGGGGAGTCAGGCAACTATGGATGAACGAAATAGACAGATCGCT<br>GAGATAGGTGCCTCACTGATTAAGCATTGGTAACTGTCAGACCAAGTTTACTCATATATACTTTAGATTGATTTAAAACTTCATTTTTAATTTAAAAG<br>GATCTAGGTGAAGATCCTTTTTGATAATCTCATGACCAAAATCCCTTAACGTGAGTTTTCGTTCCACTGAGCGTCAGACCCCGTAGAAAAGATCAAAG<br>GATCTTCTTGAGATCCTTTTTTTCTGCGCGTAATCTGCTGCTTGCAAACAAAAAAACCACCGCTACCAGCGGTGGTTTGTTTGCCGGATCAAGAGCTA<br>CCAACTCTTTTTCCGAAGGTAACTGGCTTCAGCAGAGCGCAGATACCAAATACTGTCCTTCTAGTGTAGCCGTAGTTAGGCCACCACTTCAAGAACTC<br>TGTAGCACCGCCTACATACCTCGCTCTGCTAATCCTGTTACCAGTGGCTGCTGCCAGTGGCGATAAGTCGTGTCTTACCGGGTTGGACTCAAGACGAT<br>AGTTACCGGATAAGGCGCAGCGGTCGGGCTGAACGGGGGGTTCGTGCACACAGCCCAGCTTGGAGCGAACGACCTACACCGAACTGAGATACCTACAG<br>CGTGAGCATTGAGAAAGCGCCACGCTTCCCGAAGGGAGAAAGGCGGACAGGTATCCGGTAAGCGGCAGGGTCGGAACAGGAGAGCGCACGAGGGAGCT<br>TCCAGGGGGAAACGCCTGGTATCTTTATAGTCCTGTCGGGTTTCGCCACCTCTGACTTGAGCGTCGATTTTTGTGATGCTCGTCAGGGGGGCGGAGCC<br>TATGGAAAAACGCCAGCAACGCGGCCTTTTTACGGTTCCTGGCCTTTTGCTGGCCTTTTGCTCACATGTTCTTTCCTGCGTTATCCCCTGATTCTGTG<br>GATAACCGTATTACCGCCTTTGAGTGAGCTGATACCGCTCGCCGCAGCCGAACGACCGAGCGCAGCGAGTCAGTGAGCGAGGAAGCGGAAGAGCGCCT<br>GATGCGGTATTTTCTCCTTACGCATCTGTGCGGTATTTCACACCGCAGACCAGCCGCGTAACCTGGCAAAATCGGTTACGGTTGAGTAATAAATGGAT<br>GCCCTGCGTAAGCGGGTGTGGGCGGACAATAAAGTCTTAAACTGAACAAAATAGATCTAAACTATGACAATAAAGTCTTAAACTAGACAGAATAGTTG<br>TAAACTGAAATCAGTCCAGTTATGCTGTGAAAAAGCATACTGGACTTTTGTTATGGCTAAAGCAAACTCTTCATTTTCTGAAGTGCAAATTGCCCGTC<br>GTATTAAAGAGGGGCGTGGCCAAGGGCATGGTAAAGACTATATTCGCGGCGTTGTGACAATTTACCGAACAACTCCGCGGCCGGGAAGCCGATCTCGG<br>CTTGAACGAATTGTTAGGTGGCGGTACTTGGGTCGATATCAAAGTGCATCACTTCTTCCCGTATGCCCAACTTTGTATAGAGAGCCACTGCGGGATCG<br>TCACCGTAATCTGCTTGCACGTAGATCACATAAGCACCAAGCGCGTTGGCCTCATGCTTGAGGAGATTGATGAGCGCGGTGGCAATGCCCTGCCTCCG<br>GTGCTCGCCGGAGACTGCGAGATCATAGATATAGATCTCACTACGCGGCTGCTCAAACCTGGGCAGAACGTAAGCCGCGAGAGCGCCAACAACCGCTT<br>CTTGGTCGAAGGCAGCAAGCGCGATGAATGTCTTACTACGGAGCAAGTTCCCGAGGTAATCGGAGTCCGGCTGATGTTGGGAGTAGGTGGCTACGTCT<br>CCGAACTCACGACCGAAAAGATCAAGAGCAGCCCGCATGGATTTGACTTGGTCAGGGCCGAGCCTACATGTGCGAATGATGCCCATACTTGAGCCACC<br>TAACTTTGTTTTAGGGCGACTGCCCTGCTGCGTAACATCGTTGCTGCTGCGTAACATCGTTGCTGCTCCATAACATCAAACATCGACCCACGGCGTAA<br>CGCGCTTGCTGCTTGGATGCCCGAGGCATAGACTGTACAAAAAAACAGTCATAACAAGCCATGAAAACCGCCACTGCGCCGTTACCACCGCTGCGTTC<br>GGTCAAGGTTCTGGACCAGTTGCGTGAGCGCATACGCTACTTGCATTACAGTTTACGAACCGAACAGGCTTATGTCAACTGGGTTCGTGCCTTCATCC<br>GTTTCCACGGTGTGCGTCACCCGGCAACCTTGGGCAGCAGCGAAGTCGAGGCATTTCTGTCCTGGCTGGCGAACGAGCGCAAGGTTTCGGTCTCCACG<br>CATCGTCAGGCATTGGCGGCCTTGCTGTTCTTCTACGGCAAGGTGCTGTGCACGGATCTGCCCTGGCTTCAGGAGATCGGAAGACCTCGGCCGTCGCG<br>GCGCTTGCCGGTGGTGCTGACCCCGGATGAAGTGGTTCGCATCCTCGGTTTTCTGGAAGGCGAGCATCGTTTGTTCGCCCAGGACTCTAGCTATAGTT<br>CTAGTGGTTGGCTACGTATACTCCGGAATATTAATAGATCATGGAGATAATTAAAATGATAACCATCTCGCAAATAAATAAGTATTTTACTGTTTTCG<br>TAACAGTTTTGTAATAAAAAAACCTATAAATATTCCGGATTATTCATACCGTCCCACCATCGGGCGCGGATCTCGGTCCGAAACCATGTCGTACTACC<br>ATCACCATCACCATCACGATTACGATATCCCAACGACCGAAAACCTGTATTTTCAGGGCGCCATGGGATCC |
| ceDNAFVIII-vector 14 (SEQ ID NO: 205) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGAGGAACCATTGCCACCTTCAGGGGGAGGCTGCTGGTGAATATTAACCAAGATCACCCCAGTTACCGGAGGAGCAAACAGGGACTAAGTTCACA<br>CGCGTGGTA**CCGTCTGTCTGCACATTTCGTAGAGCGAGTGTTCCGATACTCTAATCTCCCTAGGCAAGGTTCATATTTGTGTAGGTTACTTATTCTCC** |

TABLE 9-continued

| ceDNA Vector Name | Nucleic Acid Sequence |
|---|---|
| | **TTTTGTTGACTAAGTCAATAATCAGAATCAGCAGGTTTGGAGTCAGCTTGGCAGGGATCAGCAGCCTGGGTTGGAAGGAGGGGGTATAAAAGCCCCTT** |
| | **CACCAGGAGAAGCCGTCACACAGATCCACAAGCTCCTG**AAGAGGTAAGGGTTTAAGTTATCGTTAGTTCGTGCACCATTAATGTTTAATTACCTGGAG |
| | CACCTGCCTGAAATCATTTTTTTTTCAGGTTGGCTAGTATGCAGATCGAGCTCTCCACCTGCTTCTTTCTGTGCCTGTTGAGATTCTGCTTCAGCGCC |
| | ACCAGGAGATACTACCTGGGGGCTGTGGAGCTGAGCTGGGACTACATGCAGTCTGACCTGGGGGAGCTGCCTGTGGATGCCAGGTTCCCCCCCAGAGT |
| | GCCCAAGAGCTTCCCCTTCAACACCTCTGTGGTGTACAAGAAGACCCTGTTTGTGGAGTTCACTGACCACCTGTTCAACATTGCCAAGCCCAGGCCCC |
| | CCTGGATGGGCCTGCTGGGCCCCACCATCCAGGCTGAGGTGTATGACACTGTGGTGATCACCCTGAAGAACATGGCCAGCCACCCTGTGAGCCTGCAT |
| | GCTGTGGGGGTGAGCTACTGGAAGGCCTCTGAGGGGGCTGAGTATGATGACCAGACCAGCCAGAGGGAGAAGGAGGATGACAAGGTGTTCCCTGGGGG |
| | CAGCCACACCTATGTGTGGCAGGTGCTGAAGGAGAATGGCCCCATGGCCTCTGACCCCCTGTGCCTGACCTACAGCTACCTGAGCCATGTGGACCTGG |
| | TGAAGGACCTGAACTCTGGCCTGATTGGGGCCCTGCTGGTGTGCAGGGAGGGCAGCCTGGCCAAGGAGAAGACCCAGACCCTGCACAAGTTCATCCTG |
| | CTGTTTGCTGTGTTTGATGAGGGCAAGAGCTGGCACTCTGAAACCAAGAACAGCCTGATGCAGGACAGGGATGCTGCCTCTGCCAGGGCCTGGCCCAA |
| | GATGCACACTGTGAATGGCTATGTGAACAGGAGCCTGCCTGGCCTGATTGGCTGCCACAGGAAGTCTGTGTACTGGCATGTGATTGGCATGGGCACCA |
| | CCCCTGAGGTGCACAGCATCTTCCTGGAGGGCCACACCTTCCTGGTCAGGAACCACAGGCAGGCCAGCCTGGAGATCAGCCCCATCACCTTCCTGACT |
| | GCCCAGACCCTGCTGATGGACCTGGGCCAGTTCCTGCTGTTCTGCCACATCAGCAGCCACCAGCATGATGGCATGGAGGCCTATGTGAAGGTGGACAG |
| | CTGCCCTGAGGAGCCCCAGCTGAGGATGAAGAACAATGAGGAGGCTGAGGACTATGATGATGACCTGACTGACTCTGAGATGGATGTGGTGAGGTTTG |
| | ATGATGACAACAGCCCCAGCTTCATCCAGATCAGGTCTGTGGCCAAGAAGCACCCCAAGACCTGGGTGCACTACATTGCTGCTGAGGAGGAGGACTGG |
| | GACTATGCCCCCCTGGTGCTGGCCCCTGATGACAGGAGCTACAAGAGCCAGTACCTGAACAATGGCCCCCAGAGGATTGGCAGGAAGTACAAGAAGGT |
| | CAGGTTCATGGCCTACACTGATGAAACCTTCAAGACCAGGGAGGCCATCCAGCATGAGTCTGGCATCCTGGGCCCCCTGCTGTATGGGGAGGTGGGGG |
| | ACACCCTGCTGATCATCTTCAAGAACCAGGCCAGCAGGCCCTACAACATCTACCCCCATGGCATCACTGATGTGAGGCCCCTGTACAGCAGGAGGCTG |
| | CCCAAGGGGGTGAAGCACCTGAAGGACTTCCCCATCCTGCCTGGGGAGATCTTCAAGTACAAGTGGACTGTGACTGTGGAGGATGGCCCCACCAAGTC |
| | TGACCCCAGGTGCCTGACCAGATACTACAGCAGCTTTGTGAACATGGAGAGGGACCTGGCCTCTGGCCTGATTGGCCCCCTGCTGATCTGCTACAAGG |
| | AGTCTGTGGACCAGAGGGGCAACCAGATCATGTCTGACAAGAGGAATGTGATCCTGTTCTCTGTGTTTGATGAGAACAGGAGCTGGTACCTGACTGAG |
| | AACATCCAGAGGTTCCTGCCCAACCCTGCTGGGGTGCAGCTGGAGGACCCTGAGTTCCAGGCCAGCAACATCATGCACAGCATCAATGGCTATGTGTT |
| | TGACAGCCTGCAGCTGTCTGTGTGCCTGCATGAGGTGGCCTACTGGTACATCCTGAGCATTGGGGCCCAGACTGACTTCCTGTCTGTGTTCTTCTCTG |
| | GCTACACCTTCAAGCACAAGATGGTGTATGAGGACACCCTGACCCTGTTCCCCTTCTCTGGGGAGACTGTGTTCATGAGCATGGAGAACCCTGGCCTG |
| | TGGATTCTGGGCTGCCACAACTCTGACTTCAGGAACAGGGGCATGACTGCCCTGCTGAAAGTCTCCAGCTGTGACAAGAACACTGGGGACTACTATGA |
| | GGACAGCTATGAGGACATCTCTGCCTACCTGCTGAGCAAGAACAATGCCATTGAGCCCAGGAGCTTCAGCCAGAATCCACCCGTCCTTAAGCGCCATC |
| | AGCGCGAGATCACCAGGACCACCCTGCAGTCTGACCAGGAGGAGATTGACTATGATGACACCATCTCTGTGGAGATGAAGAAGGAGGACTTTGACATC |
| | TACGACGAGGACGAGAACCAGAGCCCCAGGAGCTTCCAGAAGAAGACCAGGCACTACTTCATTGCTGCTGTGGAGAGGCTGTGGGACTATGGCATGAG |
| | CAGCAGCCCCCATGTGCTGAGGAACAGGGCCCAGTCTGGCTCTGTGCCCCAGTTCAAGAAGGTGGTGTTCCAGGAGTTCACTGATGGCAGCTTCACCC |
| | AGCCCCTGTACAGAGGGGAGCTGAATGAGCACCTGGGCCTGCTGGGCCCCTACATCAGGGCTGAGGTGGAGGACAACATCATGGTGACCTTCAGGAAC |
| | CAGGCCAGCAGGCCCTACAGCTTCTACAGCAGCCTGATCAGCTATGAGGAGGACCAGAGGCAGGGGGCTGAGCCCAGGAAGAACTTTGTGAAGCCCAA |
| | TGAAACCAAGACCTACTTCTGGAAGGTGCAGCACCACATGGCCCCCACCAAGGATGAGTTTGACTGCAAGGCCTGGGCCTACTTCTCTGATGTGGACC |
| | TGGAGAAGGATGTGCACTCTGGCCTGATTGGCCCCCTGCTGGTGTGCCACACCAACACCCTGAACCCTGCCCATGGCAGGCAGGTGACTGTGCAGGAG |
| | TTTGCCCTGTTCTTCACCATCTTTGATGAAACCAAGAGCTGGTACTTCACTGAGAACATGGAGAGGAACTGCAGGGCCCCCTGCAACATCCAGATGGA |
| | GGACCCCACCTTCAAGGAGAACTACAGGTTCCATGCCATCAATGGCTACATCATGGACACCCTGCCTGGCCTGGTGATGGCCCAGGACCAGAGGATCA |
| | GGTGGTACCTGCTGAGCATGGGCAGCAATGAGAACATCCACAGCATCCACTTCTCTGGCCATGTGTTCACTGTGAGGAAGAAGGAGGAGTACAAGATG |
| | GCCCTGTACAACCTGTACCCTGGGGTGTTTGAGACTGTGGAGATGCTGCCCAGCAAGGCTGGCATCTGGAGGGTGGAGTGCCTGATTGGGGAGCACCT |
| | GCATGCTGGCATGAGCACCCTGTTCCTGGTGTACAGCAACAAGTGCCAGACCCCCCTGGGCATGGCCTCTGGCCACATCAGGGACTTCCAGATCACTG |
| | CCTCTGGCCAGTATGGCCAGTGGGCCCCCAAGCTGGCCAGGCTGCACTACTCTGGCAGCATCAATGCCTGGAGCACCAAGGAGCCCTTCAGCTGGATC |
| | AAGGTGGACCTGCTGGCCCCCATGATCATCCATGGCATCAAGACCCAGGGGGCCAGGCAGAAGTTCAGCAGCCTGTACATCAGCCAGTTCATCATCAT |
| | GTACAGCCTGGATGGCAAGAAGTGGCAGACCTACAGGGGCAACAGCACTGGCACCCTGATGGTGTTCTTTGGCAATGTGGACAGCTCTGGCATCAAGC |
| | ACAACATCTTCAACCCCCCCATCATTGCCAGATACATCAGGCTGCACCCCACCCACTACAGCATCAGGAGCACCCTGAGGATGGAGCTGATGGGCTGT |
| | GACCTGAACAGCTGCAGCATGCCCCTGGGCATGGAGAGCAAGGCCATCTCTGATGCCCAGATCACTGCCAGCAGCTACTTCACCAACATGTTTGCCAC |
| | CTGGAGCCCCAGCAAGGCCAGGCTGCATCTGCAGGGCAGGAGCAATGCCTGGAGGCCCCAGGTCAACAACCCCAAGGAGTGGCTGCAGGTGGACTTCC |
| | AGAAGACCATGAAGGTGACTGGGGTGACCACCCAGGGGGTGAAGAGCCTGCTGACCAGCATGTATGTGAAGGAGTTCCTGATCAGCAGCAGCCAGGAT |
| | GGCCACCAGTGGACCCTGTTCTTCCAGAATGGCAAGGTGAAGGTGTTCCAGGGCAACCAGGACAGCTTCACCCCTGTGGTGAACAGCCTGGACCCCCC |
| | CCTGCTGACCAGATACCTGAGGATTCACCCCCAGAGCTGGGTGCACCAGATTGCCCTGAGGATGGAGGTGCTGGGCTGTGAGGCCCAGGACCTGTACT |
| | GAGGATCCAATAAAATATCTTTATTTTCATTACATCTGTGTGTTGGTTTTTTGTGTGTTTTCCTGTAACGATCGGGTCTAGAGCATGGCTACGTAGAT |
| | AAGTAGCATGGCGGGTTAATCATTAACTACACCTGCAGGAGGAACCCCTAGTGATGGAGTTGGCCACTCCCTCTCTGCGCGCTCGCTCGCTCACTGAG |
| | GCCGGGCGACCAAAGGTCGCCCGACGCCCGGGCGGCCTCAGTGAGCGAGCGAGCGCGCAGCTGCCTGCAGGGGCGCGCCTCGAGGCATGCGGTACCAA |

TABLE 9-continued

| ceDNA Vector Name | Nucleic Acid Sequence |
|---|---|
| | GCTTGTCGAGAAGTACTAGAGGATCATAATCAGCCATACCACATTTGTAGAGGTTTTACTTGCTTTAAAAAACCTCCCACACCTCCCCCTGAACCTGA |
| | AACATAAAATGAATGCAATTGTTGTTGTTAACTTGTTTATTGCAGCTTATAATGGTTACAAATAAAGCAATAGCATCACAAATTTCACAAATAAAGCA |
| | TTTTTTTCACTGCATTCTAGTTGTGGTTTGTCCAAACTCATCAATGTATCTTATCATGTCTGGATCTGATCACTGATATCGCCTAGGAGATCCGAACC |
| | AGATAAGTGAAATCTAGTTCCAAACTATTTTGTCATTTTTAATTTTCGTATTAGCTTACGACGCTACACCCAGTTCCCATCTATTTTGTCACTCTTCC |
| | CTAAATAATCCTTAAAAACTCCATTTCCACCCCTCCCAGTTCCCAACTATTTTGTCCGCCCACAGCGGGGCATTTTTCTTCCTGTTATGTTTTTAATC |
| | AAACATCCTGCCAACTCCATGTGACAAACCGTCATCTTCGGCTACTTTTTCTCTGTCACAGAATGAAAATTTTTCTGTCATCTCTTCGTTATTAATGT |
| | TTGTAATTGACTGAATATCAACGCTTATTTGCAGCCTGAATGGCGAATGGACGCGCCCTGTAGCGGCGCATTAAGCGCGGCGGGTGTGGTGGTTACG |
| | CGCAGCGTGACCGCTACACTTGCCAGCGCCCTAGCGCCCGCTCCTTTCGCTTTCTTCCCTTCCTTTCTCGCCACGTTCGCCGGCTTTCCCCGTCAAGC |
| | TCTAAATCGGGGGCTCCCTTTAGGGTTCCGATTTAGTGCTTTACGGCACCTCGACCCCAAAAAACTTGATTAGGGTGATGGTTCACGTAGTGGGCCAT |
| | CGCCCTGATAGACGGTTTTTCGCCCTTTGACGTTGGAGTCCACGTTCTTTAATAGTGGACTCTTGTTCCAAACTGGAACAACACTCAACCCTATCTCG |
| | GTCTATTCTTTTGATTTATAAGGGATTTTGCCGATTTCGGCCTATTGGTTAAAAAATGAGCTGATTTAACAAAAATTTAACGCGAATTTTAACAAAAT |
| | ATTAACGTTTACAATTTCAGGTGGCACTTTTCGGGGAAATGTGCGCGGAACCCCTATTTGTTTATTTTTCTAAATACATTCAAATATGTATCCGCTCA |
| | TGAGACAATAACCCTGATAAATGCTTCAATAATATTGAAAAAGGAAGAGTATGAGTATTCAACATTTCCGTGTCGCCCTTATTCCCTTTTTTGCGGCA |
| | TTTTGCCTTCCTGTTTTTGCTCACCCAGAAACGCTGGTGAAAGTAAAAGATGCTGAAGATCAGTTGGGTGCACGAGTGGGTTACATCGAACTGGATCT |
| | CAACAGCGGTAAGATCCTTGAGAGTTTTCGCCCCGAAGAACGTTTTCCAATGATGAGCACTTTTAAAGTTCTGCTATGTGGCGCGGTATTATCCCGTA |
| | TTGACGCCGGGCAAGAGCAACTCGGTCGCCGCATACACTATTCTCAGAATGACTTGGTTGAGTACTCACCAGTCACAGAAAAGCATCTTACGGATGGC |
| | ATGACAGTAAGAGAATTATGCAGTGCTGCCATAACCATGAGTGATAACACTGCGGCCAACTTACTTCTGACAACGATCGGAGGACCGAAGGAGCTAAC |
| | CGCTTTTTTGCACAACATGGGGGATCATGTAACTCGCCTTGATCGTTGGGAACCGGAGCTGAATGAAGCCATACCAAACGACGAGCGTGACACCACGA |
| | TGCCTGTAGCAATGGCAACAACGTTGCGCAAACTATTAACTGGCGAACTACTTACTCTAGCTTCCCGGCAACAATTAATAGACTGGATGGAGGCGGAT |
| | AAAGTTGCAGGACCACTTCTGCGCTCGGCCCTTCCGGCTGGCTGGTTTATTGCTGATAAATCTGGAGCCGGTGAGCGTGGGTCTCGCGGTATCATTGC |
| | AGCACTGGGGCCAGATGGTAAGCCCTCCCGTATCGTAGTTATCTACACGACGGGGAGTCAGGCAACTATGGATGAACGAAATAGACAGATCGCTGAGA |
| | TAGGTGCCTCACTGATTAAGCATTGGTAACTGTCAGACCAAGTTTACTCATATATACTTTAGATTGATTTAAAACTTCATTTTTAATTTAAAAGGATC |
| | TAGGTGAAGATCCTTTTTGATAATCTCATGACCAAAATCCCTTAACGTGAGTTTTCGTTCCACTGAGCGTCAGACCCCGTAGAAAAGATCAAAGGATC |
| | TTCTTGAGATCCTTTTTTTCTGCGCGTAATCTGCTGCTTGCAAACAAAAAAACCACCGCTACCAGCGGTGGTTTGTTTGCCGGATCAAGAGCTACCAA |
| | CTCTTTTTCCGAAGGTAACTGGCTTCAGCAGAGCGCAGATACCAAATACTGTCCTTCTAGTGTAGCCGTAGTTAGGCCACCACTTCAAGAACTCTGTA |
| | GCACCGCCTACATACCTCGCTCTGCTAATCCTGTTACCAGTGGCTGCTGCCAGTGGCGATAAGTCGTGTCTTACCGGGTTGGACTCAAGACGATAGTT |
| | ACCGGATAAGGCGCAGCGGTCGGGCTGAACGGGGGGTTCGTGCACACAGCCCAGCTTGGAGCGAACGACCTACACCGAACTGAGATACCTACAGCGTG |
| | AGCATTGAGAAAGCGCCACGCTTCCCGAAGGGAGAAAGGCGGACAGGTATCCGGTAAGCGGCAGGGTCGGAACAGGAGAGCGCACGAGGGAGCTTCCA |
| | GGGGGAAACGCCTGGTATCTTTATAGTCCTGTCGGGTTTCGCCACCTCTGACTTGAGCGTCGATTTTTGTGATGCTCGTCAGGGGGGCGGAGCCTATG |
| | GAAAAACGCCAGCAACGCGGCCTTTTTACGGTTCCTGGCCTTTTGCTGGCCTTTTGCTCACATGTTCTTTCCTGCGTTATCCCCTGATTCTGTGGATA |
| | ACCGTATTACCGCCTTTGAGTGAGCTGATACCGCTCGCCGCAGCCGAACGACCGAGCGCAGCGAGTCAGTGAGCGAGGAAGCGGAAGAGCGCCTGATG |
| | CGGTATTTTCTCCTTACGCATCTGTGCGGTATTTCACACCGCAGACCAGCCGCGTAACCTGGCAAAATCGGTTACGGTTGAGTAATAAATGGATGCCC |
| | TGCGTAAGCGGGTGTGGGCGGACAATAAAGTCTTAAACTGAACAAAATAGATCTAAACTATGACAATAAAGTCTTAAACTAGACAGAATAGTTGTAAA |
| | CTGAAATCAGTCCAGTTATGCTGTGAAAAAGCATACTGGACTTTTGTTATGGCTAAAGCAAACTCTTCATTTTCTGAAGTGCAAATTGCCCGTCGTAT |
| | TAAAGAGGGGCGTGGCCAAGGGCATGGTAAAGACTATATTCGCGGCGTTGTGACAATTTACCGAACAACTCCGCGGCCGGGAAGCCGATCTCGGCTTG |
| | AACGAATTGTTAGGTGGCGGTACTTGGGTCGATATCAAAGTGCATCACTTCTTCCCGTATGCCCAACTTTGTATAGAGAGCCACTGCGGGATCGTCAC |
| | CGTAATCTGCTTGCACGTAGATCACATAAGCACCAAGCGCGTTGGCCTCATGCTTGAGGAGATTGATGAGCGCGGTGGCAATGCCCTGCCTCCGGTGC |
| | TCGCCGGAGACTGCGAGATCATAGATATAGATCTCACTACGCGGCTGCTCAAACCTGGGCAGAACGTAAGCCGCGAGAGCGCCAACAACCGCTTCTTG |
| | GTCGAAGGCAGCAAGCGCGATGAATGTCTTACTACGGAGCAAGTTCCCGAGGTAATCGGAGTCCGGCTGATGTTGGGAGTAGGTGGCTACGTCTCCGA |
| | ACTCACGACCGAAAAGATCAAGAGCAGCCCGCATGGATTTGACTTGGTCAGGGCCGAGCCTACATGTGCGAATGATGCCCATACTTGAGCCACCTAAC |
| | TTTGTTTTAGGGCGACTGCCCTGCTGCGTAACATCGTTGCTGCTGCGTAACATCGTTGCTGCTCCATAACATCAAACATCGACCCACGGCGTAACGCG |
| | CTTGCTGCTTGGATGCCCGAGGCATAGACTGTACAAAAAAACAGTCATAACAAGCCATGAAAACCGCCACTGCGCCGTTACCACCGCTGCGTTCGGTC |
| | AAGGTTCTGGACCAGTTGCGTGAGCGCATACGCTACTTGCATTACAGTTTACGAACCGAACAGGCTTATGTCAACTGGGTTCGTGCCTTCATCCGTTT |
| | CCACGGTGTGCGTCACCCGGCAACCTTGGGCAGCAGCGAAGTCGAGGCATTTCTGTCCTGGCTGGCGAACGAGCGCAAGGTTTCGGTCTCCACGCATC |
| | GTCAGGCATTGGCGGCCTTGCTGTTCTTCTACGGCAAGGTGCTGTGCACGGATCTGCCCTGGCTTCAGGAGATCGGAAGACCTCGGCCGTCGCGGCGC |
| | TTGCCGGTGGTGCTGACCCCGGATGAAGTGGTTCGCATCCTCGGTTTTCTGGAAGGCGAGCATCGTTTGTTCGCCCAGGACTCTAGCTATAGTTCTAG |
| | TGGTTGGCTACGTATACTCCGGAATATTAATAGATCATGGAGATAATTAAAATGATAACCATCTCGCAAATAAATAAGTATTTTACTGTTTTCGTAAC |
| | AGTTTTGTAATAAAAAAACCTATAAATATTCCGGATTATTCATACCGTCCCACCATCGGGCGCGGATCTCGGTCCGAAACCATGTCGTACTACCATCA |
| | CCATCACCATCACGATTACGATATCCCAACGACCGAAAACCTGTATTTTCAGGGCGCCATGGGATCC |

TABLE 9-continued

| ceDNA Vector Name | Nucleic Acid Sequence |
| --- | --- |
| ceDNAFVIII-vector 15 (SEQ ID NO: 206) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGAAGGCTCAGAGGCACACAGGAGTTTCTGGGCTCACCCTGCCCCCTTCCAACCCCTCAGTTCCCATCCTCCAGCAGCTGTTTGTGTGCTGCCTC<br>TGAAGTCCACACTGAACAAACTTCAGCCTACTCATGTCCCTAAAATGGGCAAACATTGCAAGCAGCAAACAGCAAACACACAGCCCTCCCTGCCTGCT<br>GACCTTGGAGCTGGGGCAGAGGTCAGAGACCTCTCTGGGCCCATGCCACCTCCAACATCCACTCGACCCCTTGGAATTTCGGTGGAGAGGAGCAGAGG<br>TTGTCCTGGCGTGGTTTAGGTAGTGTGAGAGGGTCCGGGTTCAAAACCACTTGCTGGGTGGGGAGTCGTCAGTAAGTGGCTATGCCCCGACCCCGAAG<br>CCTGTTTCCCCATCTGTACAATGGAAATGATAAAGACGCCCATCTGATAGGGTTTTTGTGGCAAATAAACATTTGGTTTTTTTGTTTTGTTTTGTTTT<br>GTTTTTTGAGATGGAGGTTTGCTCTGTCGCCCAGGCTGGAGTGCAGTGACACAATCTCATCTCACCACAACCTTCCCCTGCCTCAGCCTCCCAAGTAG<br>CTGGGATTACAAGCATGTGCCACCACACCTGGCTAATTTTCTATTTTTAGTAGAGACGGGTTTCTCCATGTTGGTCAGCCTCAGCCTCCCAAGTAACT<br>GGGATTACAGGCCTGTGCCACCACACCCGGCTAATTTTTTCTATTTTTGACAGGGACGGGGTTTCACCATGTTGGTCAGGCTGGTCTAGAGGTACCG**G**<br>**ATCTTGCTACCAGTGGAACAGCCACTAAGGATTCTGCAGTGAGAGCAGAGGGCCAGCTAAGTGGTACTCTCCCAGAGACTGTCTGACTCACGCCACCC**<br>**CCTCCACCTTGGACACAGGACGCTGTGGTTTCTGAGCCAGGTACAATGACTCCTTTCGGTAAGTGCAGTGGAAGCTGTACACTGCCCAGGCAAAGCGT**<br>**CCGGGCAGCGTAGGCGGGCGACTCAGATCCCAGCCAGTGGACTTAGCCCCTGTTTGCT**CCTCCGATAACTGGGGTGACCTTGGTTAATATTCACCAGC<br>AGCCTCCCCCGTTGCCCCTCTGGATCCACTGCTTAAATACGGACGAGGACAGGGCCCTGTCTCCTCAGCTTCAGGCACCACCACTGACCTGGGACAGT<br>GAATCCGGACTCTAAGGTAAATATAAAATTTTTAAGTGTATAATGTGTTAAACTACTGATTCTAATTGTTTCTCTCTTTTAGATTCCAACCTTTGGAA<br>CTGAGTTTAAACGCCGCCACCATGCAGATCGAGCTGTCTACCTGCTTCTTCCTGTGCCTGCTGCGGTTCTGCTTCAGCGCCACCAGAAGATATTACCT<br>GGGCGCCGTGGAACTGAGCTGGGACTACATGCAGTCTGACCTGGGAGAGCTGCCCGTGGACGCTAGATTTCCTCCAAGAGTGCCCAAGAGCTTCCCCT<br>TCAACACCTCCGTGGTGTACAAGAAAACCCTGTTCGTGGAATTCACCGACCACCTGTTCAATATCGCCAAGCCTCGGCCTCCTTGGATGGGACTGCTG<br>GGACCTACAATTCAGGCCGAGGTGTACGACACCGTGGTCATCACCCTGAAGAACATGGCCAGCCATCCTGTGTCTCTGCACGCCGTGGGAGTGTCTTA<br>TTGGAAGGCTTCTGAGGGCGCCGAGTACGACGATCAGACAAGCCAGAGAGAGAAAGAGGACGACAAGGTTTTCCCTGGCGGCAGCCACACCTATGTCT<br>GGCAGGTCCTGAAAGAAAACGGCCCTATGGCCTCCGATCCTCTGTGCCTGACATACAGCTACCTGAGCCACGTGGACCTGGTCAAGGACCTGAATTCT<br>GGCCTGATCGGAGCCCTGCTCGTGTGTAGAGAAGGCAGCCTGGCCAAAGAGAAAACCCAGACACTGCACAAGTTCATCCTGCTGTTCGCCGTGTTCGA<br>CGAGGGCAAGAGCTGGCACAGCGAGACAAAGAACAGCCTGATGCAGGACAGGGATGCCGCCTCTGCTAGAGCTTGGCCTAAGATGCACACCGTGAACG<br>GCTACGTGAACAGAAGCCTGCCTGGACTGATCGGCTGCCACAGAAAGTCCGTGTACTGGCACGTGATCGGCATGGGCACAACACCTGAGGTGCACAGC<br>ATCTTTCTGGAAGGCCACACCTTCCTCGTGCGGAACCACAGACAGGCCAGCCTGGAAATCAGCCCTATCACCTTCCTGACCGCTCAGACCCTGCTGAT<br>GGATCTGGGCCAGTTTCTGCTGTTCTGCCACATCAGCTCCCACCAGCACGATGGCATGGAAGCCTACGTGAAGGTGGACAGCTGCCCCGAAGAACCCC<br>AGCTGCGGATGAAGAACAACGAGGAAGCCGAGGACTACGACGACGACCTGACCGACTCTGAGATGGACGTCGTCAGATTCGACGACGATAACAGCCCC<br>AGCTTCATCCAGATCAGAAGCGTGGCCAAGAAGCACCCCAAGACCTGGGTGCACTATATCGCCGCCGAGGAAGAGGACTGGGATTACGCTCCTCTGGT<br>GCTGGCCCCTGACGACAGAAGCTACAAGAGCCAGTACCTGAACAACGGCCCTCAGCGGATCGGCCGGAAGTATAAGAAAGTGCGGTTCATGGCCTACA<br>CCGACGAGACATTCAAGACCAGAGAGGCCATCCAGCACGAGAGCGGAATTCTGGGCCCTCTGCTGTATGGCGAAGTGGGCGATACACTGCTGATCATC<br>TTCAAGAACCAGGCCAGCAGACCCTACAACATCTACCCTCACGGCATCACCGATGTGCGGCCCCTGTATTCTAGAAGGCTGCCCAAGGGCGTGAAGCA<br>CCTGAAGGACTTCCCTATCCTGCCTGGCGAGATTTTCAAGTACAAGTGGACCGTGACCGTGGAAGATGGCCCCACCAAGAGCGACCCTAGATGTCTGA<br>CACGGTACTACAGCAGCTTCGTGAACATGGAACGCGACCTGGCCAGCGGCCTGATTGGACCTCTGCTGATCTGCTACAAAGAAAGCGTGGACCAGCGG<br>GGCAACCAGATCATGAGCGACAAGCGGAACGTGATCCTGTTTAGCGTGTTCGATGAGAACCGGTCCTGGTATCTGACCGAGAACATCCAGCGGTTTCT<br>GCCCAATCCTGCCGGGGTGCAACTGGAAGATCCTGAGTTCCAGGCAAGCAACATCATGCACTCCATCAATGGCTATGTGTTCGACAGCCTGCAGCTGA<br>GCGTGTGCCTGCACGAAGTGGCCTACTGGTACATCCTGAGCATTGGCGCCCAGACCGACTTCCTGTCCGTGTTCTTTAGCGGCTACACCTTCAAGCAC<br>AAGATGGTGTACGAGGATACCCTGACACTGTTCCCATTCAGCGGCGAGACAGTGTTCATGAGCATGGAAAACCCCGGCCTGTGGATTCTGGGCTGTCA<br>CAACAGCGACTTCCGGAACAGAGGCATGACAGCCCTGCTGAAGGTGTCCAGCTGCGACAAGAACACCGGCGACTACTACGAGGACAGCTATGAGGACA<br>TCAGCGCCTACCTGCTGAGCAAGAACAATGCCATCGAGCCTCGGAGCTTCAGCCAGAATCCTCCTGTGCTGAAGCGGCACCAGCGCGAGATCACCAGA<br>ACAACCCTGCAGAGCGACCAAGAGGAAATCGATTACGACGACACCATCAGCGTCGAGATGAAGAAAGAAGATTTCGACATCTACGACGAGGACGAGAA<br>TCAGAGCCCCAGAAGCTTTCAGAAAAAGACCCGGCACTACTTCATTGCCGCCGTCGAGAGACTGTGGGACTACGGCATGTCTAGCAGCCCTCACGTGC<br>TGAGAAATAGAGCCCAGAGCGGCAGCGTGCCCCAGTTCAAGAAAGTGGTGTTCCAAGAGTTCACCGACGGCAGCTTCACCCAGCCACTGTATAGAGGC<br>GAGCTGAACGAGCATCTGGGCCTGCTGGGCCCTTATATCAGAGCCGAAGTGGAAGATAACATCATGGTCACCTTCCGGAATCAGGCTAGCCGGCCTTA<br>CAGCTTCTACAGCTCCCTGATCAGCTACGAAGAGGACCAGAGACAGGGCGCTGAGCCCAGAAAGAACTTCGTGAAGCCCAACGAGACTAAGACCTACT<br>TTTGGAAGGTGCAGCACCACATGGCCCCTACAAAGGACGAGTTCGACTGCAAAGCCTGGGCCTACTTCTCCGATGTGGATCTGGAAAAGGACGTGCAC<br>AGCGGGCTCATCGGACCACTGCTTGTGTGCCACACCAACACACTGAACCCCGCTCACGGCAGACAAGTGACAGTGCAAGAGTTCGCCCTGTTCTTCAC<br>CATCTTCGACGAAACAAAGAGCTGGTACTTCACCGAGAATATGGAACGGAACTGCAGAGCCCCTTGCAACATCCAGATGGAAGATCCCACCTTCAAAG<br>AGAACTACCGGTTCCACGCCATCAACGGCTACATCATGGACACACTGCCCGGCCTGGTTATGGCCCAGGATCAGAGAATCCGGTGGTATCTGCTGTCC<br>ATGGGCTCCAACGAGAATATCCACAGCATCCACTTCAGCGGCCACGTGTTCACCGTGCGGAAAAAAGAAGAGTACAAAATGGCCCTGTACAATCTGTA<br>CCCTGGGGTGTTCGAAACCGTGGAAATGCTGCCTTCCAAGGCCGGCATTTGGAGAGTGGAATGTCTGATTGGAGAGCACCTCCACGCCGGAATGAGCA |

TABLE 9-continued

| ceDNA Vector Name | Nucleic Acid Sequence |
| --- | --- |
| | CCCTGTTTCTGGTGTACAGCAACAAGTGTCAGACCCCTCTCGGCATGGCCTCTGGACACATCAGAGACTTCCAGATCACCGCCTCTGGCCAGTACGGA<br>CAGTGGGCTCCTAAACTGGCTCGGCTGCACTACAGCGGCAGCATCAATGCCTGGTCCACCAAAGAGCCCTTCAGCTGGATCAAGGTGGACCTGCTGGC<br>TCCCATGATCATCCACGGAATCAAGACCCAGGGCGCCAGACAGAAGTTCAGCAGCCTGTACATCAGCCAGTTCATCATCATGTACAGCCTGGACGGCA<br>AGAAGTGGCAGACCTACAGAGGCAACAGCACCGGCACACTCATGGTGTTCTTCGGCAACGTGGACTCCAGCGGCATTAAGCACAACATCTTCAACCCT<br>CCAATCATTGCCCGGTACATCCGGCTGCACCCCACACACTACAGCATCCGGTCTACCCTGAGAATGGAACTGATGGGCTGCGACCTGAACAGCTGCTC<br>TATGCCCCTCGGAATGGAAAGCAAGGCCATCAGCGACGCCCAGATCACAGCCAGCAGCTACTTCACCAACATGTTCGCCACTTGGAGCCCCTCCAAGG<br>CTAGACTGCATCTGCAGGGCAGAAGCAACGCTTGGAGGCCCCAAGTGAACAACCCCAAAGAGTGGCTGCAGGTTGACTTTCAAAAGACCATGAAAGTG<br>ACCGGCGTGACCACACAGGGCGTCAAGTCTCTGCTGACCTCTATGTACGTGAAAGAGTTCCTGATCTCCAGCAGCCAGGACGGCCATCAGTGGACCCT<br>GTTTTTCCAGAACGGCAAAGTGAAAGTGTTCCAGGGCAATCAGGACAGCTTCACACCCGTGGTCAATTCTCTGGACCCTCCACTGCTGACCAGATACC<br>TGCGGATTCACCCTCAGTCTTGGGTGCACCAGATCGCTCTGCGGATGGAAGTGCTGGGCTGTGAAGCTCAGGACCTCTACTAGTTAATTAAGAGCATC<br>TTACCGCCATTTATTCCCATATTTGTTCTGTTTTTCTTGATTTGGGTATACATTTAAATGTTAATAAAACAAAATGGTGGGGCAATCATTTACATTTT<br>TAGGGATATGTAATTACTAGTTCAGGTGTATTGCCACAAGACAAACATGTTAAGAAACTTTCCCGTTATTTACGCTCTGTTCCTGTTAATCAACCTCT<br>GGATTACAAAATTTGTGAAAGATTGACTGATATTCTTAACTATGTTGCTCCTTTTACGCTGTGTGGATATGCTGCTTTATAGCCTCTGTATCTAGCTA<br>TTGCTTCCCGTACGGCTTTCGTTTTCTCCTCCTTGTATAAATCCTGGTTGCTGTCTCTTTTAGAGGAGTTGTGGCCCGTTGTCCGTCAACGTGGCGTG<br>GTGTGCTCTGTGTTTGCTGACGCAACCCCCACTGGCTGGGGCATTGCCACCACCTGTCAACTCCTTTCTGGGACTTTCGCTTTCCCCCTCCCGATCGC<br>CACGGCAGAACTCATCGCCGCCTGCCTTGCCCGCTGCTGGACAGGGGCTAGGTTGCTGGGCACTGATAATTCCGTGGTGTTGTCTGTGCCTTCTAGTT<br>GCCAGCCATCTGTTGTTTGCCCCTCCCCCGTGCCTTCCTTGACCCTGGAAGGTGCCACTCCCACTGTCCTTTCCTAATAAAATGAGGAAATTGCATCG<br>CATTGTCTGAGTAGGTGTCATTCTATTCTGGGGGGTGGGGTGGGGCAGGACAGCAAGGGGGAGGATTGGGAAGACAATAGCAGGCATGCTGGGGATGC<br>GGTGGGCTCTATGGCTCTAGAGCATGGCTACGTAGATAAGTAGCATGGCGGGTTAATCATTAACTACACCTGCAGGAGGAACCCCTAGTGATGGAGTT<br>GGCCACTCCCTCTCTGCGCGCTCGCTCGCTCACTGAGGCCGGGCGACCAAAGGTCGCCCGACGCCCGGGCGGCCTCAGTGAGCGAGCGAGCGCGCAGC<br>TGCCTGCAGGGGCGCGCCTCGAGGCATGCGGTACCAAGCTTGTCGAGAAGTACTAGAGGATCATAATCAGCCATACCACATTTGTAGAGGTTTTACTT<br>GCTTTAAAAAACCTCCCACACCTCCCCCTGAACCTGAAACATAAAATGAATGCAATTGTTGTTGTTAACTTGTTTATTGCAGCTTATAATGGTTACAA<br>ATAAAGCAATAGCATCACAAATTTCACAAATAAAGCATTTTTTTCACTGCATTCTAGTTGTGGTTTGTCCAAACTCATCAATGTATCTTATCATGTCT<br>GGATCTGATCACTGATATCGCCTAGGAGATCCGAACCAGATAAGTGAAATCTAGTTCCAAACTATTTTGTCATTTTTAATTTTCGTATTAGCTTACGA<br>CGCTACACCCAGTTCCCATCTATTTTGTCACTCTTCCCTAAATAATCCTTAAAAACTCCATTTCCACCCCTCCCAGTTCCCAACTATTTTGTCCGCCC<br>ACAGCGGGGCATTTTTCTTCCTGTTATGTTTTTAATCAAACATCCTGCCAACTCCATGTGACAAACCGTCATCTTCGGCTACTTTTTCTCTGTCACAG<br>AATGAAAATTTTTCTGTCATCTCTTCGTTATTAATGTTTGTAATTGACTGAATATCAACGCTTATTTGCAGCCTGAATGGCGAATGGACGCGCCCTG<br>TAGCGGCGCATTAAGCGCGGCGGGTGTGGTGGTTACGCGCAGCGTGACCGCTACACTTGCCAGCGCCCTAGCGCCCGCTCCTTTCGCTTTCTTCCCTT<br>CCTTTCTCGCCACGTTCGCCGGCTTTCCCCGTCAAGCTCTAAATCGGGGGCTCCCTTTAGGGTTCCGATTTAGTGCTTTACGGCACCTCGACCCCAAA<br>AAACTTGATTAGGGTGATGGTTCACGTAGTGGGCCATCGCCCTGATAGACGGTTTTTCGCCCTTTGACGTTGGAGTCCACGTTCTTTAATAGTGGACT<br>CTTGTTCCAAACTGGAACAACACTCAACCCTATCTCGGTCTATTCTTTTGATTTATAAGGGATTTTGCCGATTTCGGCCTATTGGTTAAAAAATGAGC<br>TGATTTAACAAAAATTTAACGCGAATTTTAACAAAATATTAACGTTTACAATTTCAGGTGGCACTTTTCGGGGAAATGTGCGCGGAACCCCTATTTGT<br>TTATTTTTCTAAATACATTCAAATATGTATCCGCTCATGAGACAATAACCCTGATAAATGCTTCAATAATATTGAAAAAGGAAGAGTATGAGTATTCA<br>ACATTTCCGTGTCGCCCTTATTCCCTTTTTTGCGGCATTTTGCCTTCCTGTTTTTGCTCACCCAGAAACGCTGGTGAAAGTAAAAGATGCTGAAGATC<br>AGTTGGGTGCACGAGTGGGTTACATCGAACTGGATCTCAACAGCGGTAAGATCCTTGAGAGTTTTCGCCCCGAAGAACGTTTTCCAATGATGAGCACT<br>TTTAAAGTTCTGCTATGTGGCGCGGTATTATCCCGTATTGACGCCGGGCAAGAGCAACTCGGTCGCCGCATACACTATTCTCAGAATGACTTGGTTGA<br>GTACTCACCAGTCACAGAAAAGCATCTTACGGATGGCATGACAGTAAGAGAATTATGCAGTGCTGCCATAACCATGAGTGATAACACTGCGGCCAACT<br>TACTTCTGACAACGATCGGAGGACCGAAGGAGCTAACCGCTTTTTTGCACAACATGGGGGATCATGTAACTCGCCTTGATCGTTGGGAACCGGAGCTG<br>AATGAAGCCATACCAAACGACGAGCGTGACACCACGATGCCTGTAGCAATGGCAACAACGTTGCGCAAACTATTAACTGGCGAACTACTTACTCTAGC<br>TTCCCGGCAACAATTAATAGACTGGATGGAGGCGGATAAAGTTGCAGGACCACTTCTGCGCTCGGCCCTTCCGGCTGGCTGGTTTATTGCTGATAAAT<br>CTGGAGCCGGTGAGCGTGGGTCTCGCGGTATCATTGCAGCACTGGGGCCAGATGGTAAGCCCTCCCGTATCGTAGTTATCTACACGACGGGGAGTCAG<br>GCAACTATGGATGAACGAAATAGACAGATCGCTGAGATAGGTGCCTCACTGATTAAGCATTGGTAACTGTCAGACCAAGTTTACTCATATATACTTTA<br>GATTGATTTAAAACTTCATTTTTAATTTAAAAGGATCTAGGTGAAGATCCTTTTTGATAATCTCATGACCAAAATCCCTTAACGTGAGTTTTCGTTCC<br>ACTGAGCGTCAGACCCCGTAGAAAAGATCAAAGGATCTTCTTGAGATCCTTTTTTTCTGCGCGTAATCTGCTGCTTGCAAACAAAAAAACCACCGCTA<br>CCAGCGGTGGTTTGTTTGCCGGATCAAGAGCTACCAACTCTTTTTCCGAAGGTAACTGGCTTCAGCAGAGCGCAGATACCAAATACTGTCCTTCTAGT<br>GTAGCCGTAGTTAGGCCACCACTTCAAGAACTCTGTAGCACCGCCTACATACCTCGCTCTGCTAATCCTGTTACCAGTGGCTGCTGCCAGTGGCGATA<br>AGTCGTGTCTTACCGGGTTGGACTCAAGACGATAGTTACCGGATAAGGCGCAGCGGTCGGGCTGAACGGGGGGTTCGTGCACACAGCCCAGCTTGGAG<br>CGAACGACCTACACCGAACTGAGATACCTACAGCGTGAGCATTGAGAAAGCGCCACGCTTCCCGAAGGGAGAAAGGCGGACAGGTATCCGGTAAGCGG<br>CAGGGTCGGAACAGGAGAGCGCACGAGGGAGCTTCCAGGGGGAAACGCCTGGTATCTTTATAGTCCTGTCGGGTTTCGCCACCTCTGACTTGAGCGTC<br>GATTTTTGTGATGCTCGTCAGGGGGGCGGAGCCTATGGAAAAACGCCAGCAACGCGGCCTTTTTACGGTTCCTGGCCTTTTGCTGGCCTTTTGCTCAC |

TABLE 9-continued

| ceDNA Vector Name | Nucleic Acid Sequence |
| --- | --- |
| | ATGTTCTTTCCTGCGTTATCCCCTGATTCTGTGGATAACCGTATTACCGCCTTTGAGTGAGCTGATACCGCTCGCCGCAGCCGAACGACCGAGCGCAG<br>CGAGTCAGTGAGCGAGGAAGCGGAAGAGCGCCTGATGCGGTATTTTCTCCTTACGCATCTGTGCGGTATTTCACACCGCAGACCAGCCGCGTAACCTG<br>GCAAAATCGGTTACGGTTGAGTAATAAATGGATGCCCTGCGTAAGCGGGTGTGGGCGGACAATAAAGTCTTAAACTGAACAAAATAGATCTAAACTAT<br>GACAATAAAGTCTTAAACTAGACAGAATAGTTGTAAACTGAAATCAGTCCAGTTATGCTGTGAAAAAGCATACTGGACTTTTGTTATGGCTAAAGCAA<br>ACTCTTCATTTTCTGAAGTGCAAATTGCCCGTCGTATTAAAGAGGGGCGTGGCCAAGGGCATGGTAAAGACTATATTCGCGGCGTTGTGACAATTTAC<br>CGAACAACTCCGCGGCCGGGAAGCCGATCTCGGCTTGAACGAATTGTTAGGTGGCGGTACTTGGGTCGATATCAAAGTGCATCACTTCTTCCCGTATG<br>CCCAACTTTGTATAGAGAGCCACTGCGGGATCGTCACCGTAATCTGCTTGCACGTAGATCACATAAGCACCAAGCGCGTTGGCCTCATGCTTGAGGAG<br>ATTGATGAGCGCGGTGGCAATGCCCTGCCTCCGGTGCTCGCCGGAGACTGCGAGATCATAGATATAGATCTCACTACGCGGCTGCTCAAACCTGGGCA<br>GAACGTAAGCCGCGAGAGCGCCAACAACCGCTTCTTGGTCGAAGGCAGCAAGCGCGATGAATGTCTTACTACGGAGCAAGTTCCCGAGGTAATCGGAG<br>TCCGGCTGATGTTGGGAGTAGGTGGCTACGTCTCCGAACTCACGACCGAAAAGATCAAGAGCAGCCCGCATGGATTTGACTTGGTCAGGGCCGAGCCT<br>ACATGTGCGAATGATGCCCATACTTGAGCCACCTAACTTTGTTTTAGGGCGACTGCCCTGCTGCGTAACATCGTTGCTGCTGCGTAACATCGTTGCTG<br>CTCCATAACATCAAACATCGACCCACGGCGTAACGCGCTTGCTGCTTGGATGCCCGAGGCATAGACTGTACAAAAAAACAGTCATAACAAGCCATGAA<br>AACCGCCACTGCGCCGTTACCACCGCTGCGTTCGGTCAAGGTTCTGGACCAGTTGCGTGAGCGCATACGCTACTTGCATTACAGTTTACGAACCGAAC<br>AGGCTTATGTCAACTGGGTTCGTGCCTTCATCCGTTTCCACGGTGTGCGTCACCCGGCAACCTTGGGCAGCAGCGAAGTCGAGGCATTTCTGTCCTGG<br>CTGGCGAACGAGCGCAAGGTTTCGGTCTCCACGCATCGTCAGGCATTGGCGGCCTTGCTGTTCTTCTACGGCAAGGTGCTGTGCACGGATCTGCCCTG<br>GCTTCAGGAGATCGGAAGACCTCGGCCGTCGCGGCGCTTGCCGGTGGTGCTGACCCCGGATGAAGTGGTTCGCATCCTCGGTTTTCTGGAAGGCGAGC<br>ATCGTTTGTTCGCCCAGGACTCTAGCTATAGTTCTAGTGGTTGGCTACGTATACTCCGGAATATTAATAGATCATGGAGATAATTAAAATGATAACCA<br>TCTCGCAAATAAATAAGTATTTTACTGTTTTCGTAACAGTTTTGTAATAAAAAAACCTATAAATATTCCGGATTATTCATACCGTCCCACCATCGGGC<br>GCGGATCTCGGTCCGAAACCATGTCGTACTACCATCACCATCACCATCACGATTACGATATCCCAACGACCGAAAACCTGTATTTTCAGGGCGCCATG<br>GGATCC |
| ceDNAFVIII-vector 16 (SEQ ID NO: 207) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGAAGGCTCAGAGGCACACAGGAGTTTCTGGGCTCACCCTGCCCCCTTCCAACCCCTCAGTTCCCATCCTCCAGCAGCTGTTTGTGTGCTGCCTC<br>TGAAGTCCACACTGAACAAACTTCAGCCTACTCATGTCCCTAAAATGGGCAAACATTGCAAGCAGCAAACAGCAAACACACAGCCCTCCCTGCCTGCT<br>GACCTTGGAGCTGGGGCAGAGGTCAGAGACCTCTCTGGGCCCATGCCACCTCCAACATCCACTCGACCCCTTGGAATTTCGGTGGAGAGGAGCAGAGG<br>TTGTCCTGGCGTGGTTTAGGTAGTGTGAGAGGGTCCGGGTTCAAAACCACTTGCTGGGTGGGGAGTCGTCAGTAAGTGGCTATGCCCCGACCCCGAAG<br>CCTGTTTCCCCATCTGTACAATGGAAATGATAAAGACGCCCATCTGATAGGGTTTTTGTGGCAAATAAACATTTGGTTTTTTTGTTTTGTTTTGTTTT<br>GTTTTTGAGATGGAGGTTTGCTCTGTCGCCCAGGCTGGAGTGCAGTGACACAATCTCATCTCACCACAACCTTCCCCTGCCTCAGCCTCCCAAGTAG<br>CTGGGATTACAAGCATGTGCCACCACACCTGGCTAATTTTCTATTTTTAGTAGAGACGGGTTTCTCCATGTTGGTCAGCCTCAGCCTCCCAAGTAACT<br>GGGATTACAGGCCTGTGCCACCACACCCGGCTAATTTTTTCTATTTTTGACAGGGACGGGGTTTCACCATGTTGGTCAGGCTGGTCTAGAGGTACCG**G**<br>**ATCTTGCTACCAGTGGAACAGCCACTAAGGATTCTGCAGTGAGAGCAGAGGGCCAGCTAAGTGGTACTCTCCCAGAGACTGTCTGACTCACGCCACCC**<br>**CCTCCACCTTGGACACAGGACGCTGTGGTTTCTGAGCCAGGTACAATGACTCCTTTCGGTAAGTGCAGTGGAAGCTGTACACTGCCCAGGCAAAGCGT**<br>**CCGGGCAGCGTAGGCGGGCGACTCAGATCCCAGCCAGTGGACTTAGCCCCTGTTTGCT**CCTCCGATAACTGGGGTGACCTTGGTTAATATTCACCAGC<br>AGCCTCCCCCGTTGCCCCTCTGGATCCACTGCTTAAATACGGACGAGGACAGGGCCCTGTCTCCTCAGCTTCAGGCACCACCACTGACCTGGGACAGT<br>GAATCCGGACTCTAAGGTAAATATAAAATTTTTAAGTGTATAATGTGTTAAACTACTGATTCTAATTGTTTCTCTCTTTTAGATTCCAACCTTTGGAA<br>CTGAGTTTAAACGCCGCCACCATGCAGATTGAGCTGAGCACCTGCTTCTTCCTGTGCCTGCTGAGGTTCTGCTTCTCTGCCACCAGGAGATACTACCT<br>GGGGGCTGTGGAGCTGAGCTGGGACTACATGCAGTCTGACCTGGGGGAGCTGCCTGTGGATGCCAGGTTCCCCCCCAGAGTGCCCAAGAGCTTCCCCT<br>TCAACACCTCTGTGGTGTACAAGAAGACCCTGTTTGTGGAGTTCACTGACCACCTGTTCAACATTGCCAAGCCCAGGCCCCCCTGGATGGCCTGCTG<br>GGCCCCACCATCCAGGCTGAGGTGTATGACACTGTGGTGATCACCCTGAAGAACATGGCCAGCCACCCTGTGAGCCTGCATGCTGTGGGGGTGAGCTA<br>CTGGAAGGCCTCTGAGGGGGCTGAGTATGATGACCAGACCAGCCAGAGGGAGAAGGAGGATGACAAGGTGTTCCCTGGGGGCAGCCACACCTATGTGT<br>GGCAGGTGCTGAAGGAGAATGGCCCCATGGCCTCTGACCCCCTGTGCCTGACCTACAGCTACCTGAGCCATGTGGACCTGGTGAAGGACCTGAACTCT<br>GGCCTGATTGGGGCCCTGCTGGTGTGCAGGGAGGGCAGCCTGGCCAAGGAGAAGACCCAGACCCTGCACAAGTTCATCCTGCTGTTTGCTGTGTTTGA<br>TGAGGGCAAGAGCTGGCACTCTGAAACCAAGAACAGCCTGATGCAGGACAGGGATGCTGCCTCTGCCAGGGCCTGGCCCAAGATGCACACTGTGAATG<br>GCTATGTGAACAGGAGCCTGCCTGGCCTGATTGGCTGCCACAGGAAGTCTGTGTACTGGCATGTGATTGGCATGGGCACCACCCCTGAGGTGCACAGC<br>ATCTTCCTGGAGGGCCACACCTTCCTGGTCAGGAACCACAGGCAGGCCAGCCTGGAGATCAGCCCCATCACCTTCCTGACTGCCCAGACCCTGCTGAT<br>GGACCTGGGCCAGTTCCTGCTGTTCTGCCACATCAGCAGCCACCAGCATGATGGCATGGAGGCCTATGTGAAGGTGGACAGCTGCCCTGAGGAGCCCC<br>AGCTGAGGATGAAGAACAATGAGGAGGCTGAGGACTATGATGATGACCTGACTGACTCTGAGATGGATGTGGTGAGGTTTGATGATGACAACAGCCCC<br>AGCTTCATCCAGATCAGGTCTGTGGCCAAGAAGCACCCCAAGACCTGGGTGCACTACATTGCTGCTGAGGAGGAGGACTGGGACTATGCCCCCCTGGT<br>GCTGGCCCCTGATGACAGGAGCTACAAGAGCCAGTACCTGAACAATGGCCCCCAGAGGATTGGCAGGAAGTACAAGAAGGTCAGGTTCATGGCCTACA |

TABLE 9-continued

| ceDNA Vector Name | Nucleic Acid Sequence |
|---|---|
| | CTGATGAAACCTTCAAGACCAGGGAGGCCATCCAGCATGAGTCTGGCATCCTGGGCCCCCTGCTGTATGGGGAGGTGGGGGACACCCTGCTGATCATC |
| | TTCAAGAACCAGGCCAGCAGGCCCTACAACATCTACCCCCATGGCATCACTGATGTGAGGCCCCTGTACAGCAGGAGGCTGCCCAAGGGGGTGAAGCA |
| | CCTGAAGGACTTCCCCATCCTGCCTGGGGAGATCTTCAAGTACAAGTGGACTGTGACTGTGGAGGATGGCCCCACCAAGTCTGACCCCAGGTGCCTGA |
| | CCAGATACTACAGCAGCTTTGTGAACATGGAGAGGGACCTGGCCTCTGGCCTGATTGGCCCCCTGCTGATCTGCTACAAGGAGTCTGTGGACCAGAGG |
| | GGCAACCAGATCATGTCTGACAAGAGGAATGTGATCCTGTTCTCTGTGTTTGATGAGAACAGGAGCTGGTACCTGACTGAGAACATCCAGAGGTTCCT |
| | GCCCAACCCTGCTGGGGTGCAGCTGGAGGACCCTGAGTTCCAGGCCAGCAACATCATGCACAGCATCAATGGCTATGTGTTTGACAGCCTGCAGCTGT |
| | CTGTGTGCCTGCATGAGGTGGCCTACTGGTACATCCTGAGCATTGGGGCCCAGACTGACTTCCTGTCTGTGTTCTTCTCTGGCTACACCTTCAAGCAC |
| | AAGATGGTGTATGAGGACACCCTGACCCTGTTCCCCTTCTCTGGGGAGACTGTGTTCATGAGCATGGAGAACCCTGGCCTGTGGATTCTGGGCTGCCA |
| | CAACTCTGACTTCAGGAACAGGGGCATGACTGCCCTGCTGAAAGTCTCCAGCTGTGACAAGAACACTGGGGACTACTATGAGGACAGCTATGAGGACA |
| | TCTCTGCCTACCTGCTGAGCAAGAACAATGCCATTGAGCCCAGGAGCTTCAGCCAGAATGCCACTAATGTGTCTAACAACAGCAACACCAGCAATGAC |
| | AGCAATGTGTCTCCCCCAGTGCTGAAGAGGCACCAGAGGGAGATCACCAGGACCACCCTGCAGTCTGACCAGGAGGAGATTGACTATGATGACACCAT |
| | CTCTGTGGAGATGAAGAAGGAGGACTTTGACATCTACGACGAGGACGAGAACCAGAGCCCCAGGAGCTTCCAGAAGAAGACCAGGCACTACTTCATTG |
| | CTGCTGTGGAGAGGCTGTGGGACTATGGCATGAGCAGCAGCCCCCATGTGCTGAGGAACAGGGCCCAGTCTGGCTCTGTGCCCCAGTTCAAGAAGGTG |
| | GTGTTCCAGGAGTTCACTGATGGCAGCTTCACCCAGCCCCTGTACAGAGGGGAGCTGAATGAGCACCTGGGCCTGCTGGGCCCCTACATCAGGGCTGA |
| | GGTGGAGGACAACATCATGGTGACCTTCAGGAACCAGGCCAGCAGGCCCTACAGCTTCTACAGCAGCCTGATCAGCTATGAGGAGGACCAGAGGCAGG |
| | GGGCTGAGCCCAGGAAGAACTTTGTGAAGCCCAATGAAACCAAGACCTACTTCTGGAAGGTGCAGCACCACATGGCCCCCACCAAGGATGAGTTTGAC |
| | TGCAAGGCCTGGGCCTACTTCTCTGATGTGGACCTGGAGAAGGATGTGCACTCTGGCCTGATTGGCCCCCTGCTGGTGTGCCACACCAACACCCTGAA |
| | CCCTGCCCATGGCAGGCAGGTGACTGTGCAGGAGTTTGCCCTGTTCTTCACCATCTTTGATGAAACCAAGAGCTGGTACTTCACTGAGAACATGGAGA |
| | GGAACTGCAGGGCCCCCTGCAACATCCAGATGGAGGACCCCACCTTCAAGGAGAACTACAGGTTCCATGCCATCAATGGCTACATCATGGACACCCTG |
| | CCTGGCCTGGTGATGGCCCAGGACCAGAGGATCAGGTGGTACCTGCTGAGCATGGGCAGCAATGAGAACATCCACAGCATCCACTTCTCTGGCCATGT |
| | GTTCACTGTGAGGAAGAAGGAGGAGTACAAGATGGCCCTGTACAACCTGTACCCTGGGGTGTTTGAGACTGTGGAGATGCTGCCCAGCAAGGCTGGCA |
| | TCTGGAGGGTGGAGTGCCTGATTGGGGAGCACCTGCATGCTGGCATGAGCACCCTGTTCCTGGTGTACAGCAACAAGTGCCAGACCCCCCTGGGCATG |
| | GCCTCTGGCCACATCAGGGACTTCCAGATCACTGCCTCTGGCCAGTATGGCCAGTGGGCCCCCAAGCTGGCCAGGCTGCACTACTCTGGCAGCATCAA |
| | TGCCTGGAGCACCAAGGAGCCCTTCAGCTGGATCAAGGTGGACCTGCTGGCCCCCATGATCATCCATGGCATCAAGACCCAGGGGGCCAGGCAGAAGT |
| | TCAGCAGCCTGTACATCAGCCAGTTCATCATCATGTACAGCCTGGATGGCAAGAAGTGGCAGACCTACAGGGGCAACAGCACTGGCACCCTGATGGTG |
| | TTCTTTGGCAATGTGGACAGCTCTGGCATCAAGCACAACATCTTCAACCCCCCCATCATTGCCAGATACATCAGGCTGCACCCCACCCACTACAGCAT |
| | CAGGAGCACCCTGAGGATGGAGCTGATGGGCTGTGACCTGAACAGCTGCAGCATGCCCCTGGGCATGGAGAGCAAGGCCATCTCTGATGCCCAGATCA |
| | CTGCCAGCAGCTACTTCACCAACATGTTTGCCACCTGGAGCCCCAGCAAGGCCAGGCTGCACCTGCAGGGCAGGAGCAATGCCTGGAGGCCCCAGGTC |
| | AACAACCCCAAGGAGTGGCTGCAGGTGGACTTCCAGAAGACCATGAAGGTGACTGGGGTGACCACCCAGGGGGTGAAGAGCCTGCTGACCAGCATGTA |
| | TGTGAAGGAGTTCCTGATCAGCAGCAGCCAGGATGGCCACCAGTGGACCCTGTTCTTCCAGAATGGCAAGGTGAAGGTGTTCCAGGGCAACCAGGACA |
| | GCTTCACCCCTGTGGTGAACAGCCTGGACCCCCCCCTGCTGACCAGATACCTGAGGATTCACCCCCAGAGCTGGGTGCACCAGATTGCCCTGAGGATG |
| | GAGGTGCTGGGCTGTGAGGCCCAGGACCTGTACTGATTAATTAAGAGCATCTTACCGCCATTTATTCCCATATTTGTTCTGTTTTTCTTGATTTGGGT |
| | ATACATTTAAATGTTAATAAAACAAAATGGTGGGGCAATCATTTACATTTTTAGGGATATGTAATTACTAGTTCAGGTGTATTGCCACAAGACAAACA |
| | TGTTAAGAAACTTTCCCGTTATTTACGCTCTGTTCCTGTTAATCAACCTCTGGATTACAAAATTTGTGAAAGATTGACTGATATTCTTAACTATGTTG |
| | CTCCTTTTACGCTGTGTGGATATGCTGCTTTATAGCCTCTGTATCTAGCTATTGCTTCCCGTACGGCTTTCGTTTTCTCCTCCTTGTATAAATCCTGG |
| | TTGCTGTCTCTTTAGAGGAGTTGTGGCCCGTTGTCCGTCAACGTGGCGTGGTGTGCTCTGTGTTTGCTGACGCAACCCCCACTGGCTGGGGCATTGC |
| | CACCACCTGTCAACTCCTTTCTGGGACTTTCGCTTTCCCCCTCCCGATCGCCACGGCAGAACTCATCGCCGCCTGCCTTGCCCGCTGCTGGACAGGGG |
| | CTAGGTTGCTGGGCACTGATAATTCCGTGGTGTTGTCTGTGCCTTCTAGTTGCCAGCCATCTGTTGTTTGCCCCTCCCCCGTGCCTTCCTTGACCCTG |
| | GAAGGTGCCACTCCCACTGTCCTTTCCTAATAAAATGAGGAAATTGCATCGCATTGTCTGAGTAGGTGTCATTCTATTCTGGGGGGTGGGGTGGGGCA |
| | GGACAGCAAGGGGGAGGATTGGGAAGACAATAGCAGGCATGCTGGGGATGCGGTGGGCTCTATGGCTCTAGAGCATGGCTACGTAGATAAGTAGCATG |
| | GCGGGTTAATCATTAACTACACCTGCAGGAGGAACCCCTAGTGATGGAGTTGGCCACTCCCTCTCTGCGCGCTCGCTCGCTCACTGAGGCCGGGCGAC |
| | CAAAGGTCGCCCGACGCCCGGGCGGCCTCAGTGAGCGAGCGAGCGCGCAGCTGCCTGCAGGGGCGCGCCTCGAGGCATGCGGTACCAAGCTTGTCGAG |
| | AAGTACTAGAGGATCATAATCAGCCATACCACATTTGTAGAGGTTTTACTTGCTTTAAAAAACCTCCCACACCTCCCCCTGAACCTGAAACATAAAAT |
| | GAATGCAATTGTTGTTGTTAACTTGTTTATTGCAGCTTATAATGGTTACAAATAAAGCAATAGCATCACAAATTTCACAAATAAAGCATTTTTTTCAC |
| | TGCATTCTAGTTGTGGTTTGTCCAAACTCATCAATGTATCTTATCATGTCTGGATCTGATCACTGATATCGCCTAGGAGATCCGAACCAGATAAGTGA |
| | AATCTAGTTCCAAACTATTTTGTCATTTTTAATTTTCGTATTAGCTTACGACGCTACACCCAGTTCCCATCTATTTTGTCACTCTTCCCTAAATAATC |
| | CTTAAAAACTCCATTTCCACCCCTCCCAGTTCCCAACTATTTTGTCCGCCCACAGCGGGGCATTTTTCTTCCTGTTATGTTTTTAATCAAACATCCTG |
| | CCAACTCCATGTGACAAACCGTCATCTTCGGCTACTTTTTCTCTGTCACAGAATGAAAATTTTTCTGTCATCTCTTCGTTATTAATGTTTGTAATTGA |
| | CTGAATATCAACGCTTATTTGCAGCCTGAATGGCGAATGGACGCGCCCTGTAGCGGCGCATTAAGCGCGGCGGGTGTGGTGGTTACGCGCAGCGTGA |
| | CCGCTACACTTGCCAGCGCCCTAGCGCCCGCTCCTTTCGCTTTCTTCCCTTCCTTTCTCGCCACGTTCGCCGGCTTTCCCCGTCAAGCTCTAAATCGG |

TABLE 9-continued

| ceDNA Vector Name | Nucleic Acid Sequence |
|---|---|
| | GGGCTCCCTTTAGGGTTCCGATTTAGTGCTTTACGGCACCTCGACCCCAAAAAACTTGATTAGGGTGATGGTTCACGTAGTGGGCCATCGCCCTGATA GACGGTTTTTCGCCCTTTGACGTTGGAGTCCACGTTCTTTAATAGTGGACTCTTGTTCCAAACTGGAACAACACTCAACCCTATCTCGGTCTATTCTT TTGATTTATAAGGGATTTTGCCGATTTCGGCCTATTGGTTAAAAAATGAGCTGATTTAACAAAAATTTAACGCGAATTTTAACAAAATATTAACGTTT ACAATTTCAGGTGGCACTTTTCGGGGAAATGTGCGCGGAACCCCTATTTGTTTATTTTTCTAAATACATTCAAATATGTATCCGCTCATGAGACAATA ACCCTGATAAATGCTTCAATAATATTGAAAAAGGAAGAGTATGAGTATTCAACATTTCCGTGTCGCCCTTATTCCCTTTTTTGCGGCATTTTGCCTTC CTGTTTTTGCTCACCCAGAAACGCTGGTGAAAGTAAAAGATGCTGAAGATCAGTTGGGTGCACGAGTGGGTTACATCGAACTGGATCTCAACAGCGGT AAGATCCTTGAGAGTTTTCGCCCCGAAGAACGTTTTCCAATGATGAGCACTTTTAAAGTTCTGCTATGTGGCGCGGTATTATCCCGTATTGACGCCGG GCAAGAGCAACTCGGTCGCCGCATACACTATTCTCAGAATGACTTGGTTGAGTACTCACCAGTCACAGAAAAGCATCTTACGGATGGCATGACAGTAA GAGAATTATGCAGTGCTGCCATAACCATGAGTGATAACACTGCGGCCAACTTACTTCTGACAACGATCGGAGGACCGAAGGAGCTAACCGCTTTTTTG CACAACATGGGGGATCATGTAACTCGCCTTGATCGTTGGGAACCGGAGCTGAATGAAGCCATACCAAACGACGAGCGTGACACCACGATGCCTGTAGC AATGGCAACAACGTTGCGCAAACTATTAACTGGCGAACTACTTACTCTAGCTTCCCGGCAACAATTAATAGACTGGATGGAGGCGGATAAAGTTGCAG GACCACTTCTGCGCTCGGCCCTTCCGGCTGGCTGGTTTATTGCTGATAAATCTGGAGCCGGTGAGCGTGGGTCTCGCGGTATCATTGCAGCACTGGGG CCAGATGGTAAGCCCTCCCGTATCGTAGTTATCTACACGACGGGGAGTCAGGCAACTATGGATGAACGAAATAGACAGATCGCTGAGATAGGTGCCTC ACTGATTAAGCATTGGTAACTGTCAGACCAAGTTTACTCATATATACTTTAGATTGATTTAAAACTTCATTTTTAATTTAAAAGGATCTAGGTGAAGA TCCTTTTTGATAATCTCATGACCAAAATCCCTTAACGTGAGTTTTCGTTCCACTGAGCGTCAGACCCCGTAGAAAAGATCAAAGGATCTTCTTGAGAT CCTTTTTTTCTGCGCGTAATCTGCTGCTTGCAAACAAAAAAACCACCGCTACCAGCGGTGGTTTGTTTGCCGGATCAAGAGCTACCAACTCTTTTTCC GAAGGTAACTGGCTTCAGCAGAGCGCAGATACCAAATACTGTCCTTCTAGTGTAGCCGTAGTTAGGCCACCACTTCAAGAACTCTGTAGCACCGCCTA CATACCTCGCTCTGCTAATCCTGTTACCAGTGGCTGCTGCCAGTGGCGATAAGTCGTGTCTTACCGGGTTGGACTCAAGACGATAGTTACCGGATAAG GCGCAGCGGTCGGGCTGAACGGGGGGTTCGTGCACACAGCCCAGCTTGGAGCGAACGACCTACACCGAACTGAGATACCTACAGCGTGAGCATTGAGA AAGCGCCACGCTTCCCGAAGGGAGAAAGGCGGACAGGTATCCGGTAAGCGGCAGGGTCGGAACAGGAGAGCGCACGAGGGAGCTTCCAGGGGGAAACG CCTGGTATCTTTATAGTCCTGTCGGGTTTCGCCACCTCTGACTTGAGCGTCGATTTTTGTGATGCTCGTCAGGGGGGCGGAGCCTATGGAAAAACGCC AGCAACGCGGCCTTTTTACGGTTCCTGGCCTTTTGCTGGCCTTTTGCTCACATGTTCTTTCCTGCGTTATCCCCTGATTCTGTGGATAACCGTATTAC CGCCTTTGAGTGAGCTGATACCGCTCGCCGCAGCCGAACGACCGAGCGCAGCGAGTCAGTGAGCGAGGAAGCGGAAGAGCGCCTGATGCGGTATTTTC TCCTTACGCATCTGTGCGGTATTTCACACCGCAGACCAGCCGCGTAACCTGGCAAAATCGGTTACGGTTGAGTAATAAATGGATGCCCTGCGTAAGCG GGTGTGGGCGGACAATAAAGTCTTAAACTGAACAAAATAGATCTAAACTATGACAATAAAGTCTTAAACTAGACAGAATAGTTGTAAACTGAAATCAG TCCAGTTATGCTGTGAAAAAGCATACTGGACTTTTGTTATGGCTAAAGCAAACTCTTCATTTTCTGAAGTGCAAATTGCCCGTCGTATTAAAGAGGGG CGTGGCCAAGGGCATGGTAAAGACTATATTCGCGGCGTTGTGACAATTTACCGAACAACTCCGCGGCCGGGAAGCCGATCTCGGCTTGAACGAATTGT TAGGTGGCGGTACTTGGGTCGATATCAAAGTGCATCACTTCTTCCCGTATGCCCAACTTTGTATAGAGAGCCACTGCGGGATCGTCACCGTAATCTGC TTGCACGTAGATCACATAAGCACCAAGCGCGTTGGCCTCATGCTTGAGGAGATTGATGAGCGCGGTGGCAATGCCCTGCCTCCGGTGCTCGCCGGAGA CTGCGAGATCATAGATATAGATCTCACTACGCGGCTGCTCAAACCTGGGCAGAACGTAAGCCGCGAGAGCGCCAACAACCGCTTCTTGGTCGAAGGCA GCAAGCGCGATGAATGTCTTACTACGGAGCAAGTTCCCGAGGTAATCGGAGTCCGGCTGATGTTGGGAGTAGGTGGCTACGTCTCCGAACTCACGACC GAAAAGATCAAGAGCAGCCCGCATGGATTTGACTTGGTCAGGGCCGAGCCTACATGTGCGAATGATGCCCATACTTGAGCCACCTAACTTTGTTTTAG GGCGACTGCCCTGCTGCGTAACATCGTTGCTGCTGCGTAACATCGTTGCTGCTCCATAACATCAAACATCGACCCACGGCGTAACGCGCTTGCTGCTT GGATGCCCGAGGCATAGACTGTACAAAAAAACAGTCATAACAAGCCATGAAAACCGCCACTGCGCCGTTACCACCGCTGCGTTCGGTCAAGGTTCTGG ACCAGTTGCGTGAGCGCATACGCTACTTGCATTACAGTTTACGAACCGAACAGGCTTATGTCAACTGGGTTCGTGCCTTCATCCGTTTCCACGGTGTG CGTCACCCGGCAACCTTGGGCAGCAGCGAAGTCGAGGCATTTCTGTCCTGGCTGGCGAACGAGCGCAAGGTTTCGGTCTCCACGCATCGTCAGGCATT GGCGGCCTTGCTGTTCTTCTACGGCAAGGTGCTGTGCACGGATCTGCCCTGGCTTCAGGAGATCGGAAGACCTCGGCCGTCGCGGCGCTTGCCGGTGG TGCTGACCCCGGATGAAGTGGTTCGCATCCTCGGTTTTCTGGAAGGCGAGCATCGTTTGTTCGCCCAGGACTCTAGCTATAGTTCTAGTGGTTGGCTA CGTATACTCCGGAATATTAATAGATCATGGAGATAATTAAAATGATAACCATCTCGCAAATAAATAAGTATTTTACTGTTTTCGTAACAGTTTTGTAA TAAAAAAACCTATAAATATTCCGGATTATTCATACCGTCCCACCATCGGGCGCGGATCTCGGTCCGAAACCATGTCGTACTACCATCACCATCACCAT CACGATTACGATATCCCAACGACCGAAAACCTGTATTTTCAGGGCGCCATGGGATCC |
| ceDNAFVIII-vector 17 (SEQ ID NO: 208) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA GCGAGCGAGCGCGCAGAGAGGGAGTGGCCAACTCCATCACTAGGGGTTCCTTGTAGTTAATGATTAACCCGCCATGCTACTTATCTACGTAGCCATGC TCTAGAAGGCTCAGAGGCACACAGGAGTTTCTGGGCTCACCCTGCCCCCTTCCAACCCCTCAGTTCCCATCCTCCAGCAGCTGTTTGTGTGCTGCCTC TGAAGTCCACACTGAACAAACTTCAGCCTACTCATGTCCCTAAAATGGGCAAACATTGCAAGCAGCAAACAGCAAACACACAGCCCTCCCTGCCTGCT GACCTTGGAGCTGGGGCAGAGGTCAGAGACCTCTCTGGGCCCATGCCACCTCCAACATCCACTCGACCCCTTGGAATTTCGGTGGAGAGGAGCAGAGG TTGTCCTGGCGTGGTTTAGGTAGTGTGAGAGGGTCCGGGTTCAAAACCACTTGCTGGGTGGGGAGTCGTCAGTAAGTGGCTATGCCCCGACCCCGAAG CCTGTTTCCCCATCTGTACAATGGAAATGATAAAGACGCCCATCTGATAGGGTTTTTGTGGCAAATAAACATTTGGTTTTTTTGTTTTGTTTTGTTTT GTTTTTGAGATGGAGGTTTGCTCTGTCGCCCAGGCTGGAGTGCAGTGACACAATCTCATCTCACCACAACCTTCCCCTGCCTCAGCCTCCCAAGTAG |

TABLE 9-continued

| ceDNA Vector Name | Nucleic Acid Sequence |
|---|---|
| | CTGGGATTACAAGCATGTGCCACCACACCTGGCTAATTTTCTATTTTTAGTAGAGACGGGTTTCTCCATGTTGGTCAGCCTCAGCCTCCCAAGTAACT<br>GGGATTACAGGCCTGTGCCACCACACCCGGCTAATTTTTTCTATTTTTGACAGGGACGGGGTTTCACCATGTTGGTCAGGCTGGTCTAGAGGTACCG**G**<br>**ATCTTGCTACCAGTGGAACAGCCACTAAGGATTCTGCAGTGAGAGCAGAGGGCCAGCTAAGTGGTACTCTCCCAGAGACTGTCTGACTCACGCCACCC**<br>**CCTCCACCTTGGACACAGGACGCTGTGGTTTCTGAGCCAGGTACAATGACTCCTTTCGGTAAGTGCAGTGGAAGCTGTACACTGCCCAGGCAAAGCGT**<br>**CCGGGCAGCGTAGGCGGGCGACTCAGATCCCAGCCAGTGGACTTAGCCCCTGTTTGCT**CCTCCGATAACTGGGGTGACCTTGGTTAATATTCACCAGC<br>AGCCTCCCCCGTTGCCCCTCTGGATCCACTGCTTAAATACGGACGAGGACAGGGCCCTGTCTCCTCAGCTTCAGGCACCACCACTGACCTGGGACAGT<br>GAATCCGGACTCTAAGGTAAATATAAAATTTTTAAGTGTATAATGTGTTAAACTACTGATTCTAATTGTTTCTCTCTTTTAGATTCCAACCTTTGGAA<br>CTGAGTTTAAACGCCGCCACCATGCAGATTGAGCTGAGCACCTGCTTCTTCCTGTGCCTGCTGAGGTTCTGCTTCTCTGCCACCAGGAGATACTACCT<br>GGGGGCTGTGGAGCTGAGCTGGGACTACATGCAGTCTGACCTGGGGGAGCTGCCTGTGGATGCCAGGTTCCCCCCCAGAGTGCCCAAGAGCTTCCCCT<br>TCAACACCTCTGTGGTGTACAAGAAGACCCTGTTTGTGGAGTTCACTGACCACCTGTTCAACATTGCCAAGCCCAGGCCCCCCTGGATGGGCCTGCTG<br>GGCCCCACCATCCAGGCTGAGGTGTATGACACTGTGGTGATCACCCTGAAGAACATGGCCAGCCACCCTGTGAGCCTGCATGCTGTGGGGGTGAGCTA<br>CTGGAAGGCCTCTGAGGGGGCTGAGTATGATGACCAGACCAGCCAGAGGGAGAAGGAGGATGACAAGGTGTTCCCTGGGGGCAGCCACACCTATGTGT<br>GGCAGGTGCTGAAGGAGAATGGCCCCATGGCCTCTGACCCCCTGTGCCTGACCTACAGCTACCTGAGCCATGTGGACCTGGTGAAGGACCTGAACTCT<br>GGCCTGATTGGGGCCCTGCTGGTGTGCAGGGAGGGCAGCCTGGCCAAGGAGAAGACCCAGACCCTGCACAAGTTCATCCTGCTGTTTGCTGTGTTTGA<br>TGAGGGCAAGAGCTGGCACTCTGAAACCAAGAACAGCCTGATGCAGGACAGGGATGCTGCCTCTGCCAGGGCCTGGCCCAAGATGCACACTGTGAATG<br>GCTATGTGAACAGGAGCCTGCCTGGCCTGATTGGCTGCCACAGGAAGTCTGTGTACTGGCATGTGATTGGCATGGGCACCACCCCTGAGGTGCACAGC<br>ATCTTCCTGGAGGGCCACACCTTCCTGGTCAGGAACCACAGGCAGGCCAGCCTGGAGATCAGCCCCATCACCTTCCTGACTGCCCAGACCCTGCTGAT<br>GGACCTGGGCCAGTTCCTGCTGTTCTGCCACATCAGCAGCCACCAGCATGATGGCATGGAGGCCTATGTGAAGGTGGACAGCTGCCCTGAGGAGCCCC<br>AGCTGAGGATGAAGAACAATGAGGAGGCTGAGGACTATGATGATGACCTGACTGACTCTGAGATGGATGTGGTGAGGTTTGATGATGACAACAGCCCC<br>AGCTTCATCCAGATCAGGTCTGTGGCCAAGAAGCACCCCAAGACCTGGGTGCACTACATTGCTGCTGAGGAGGAGGACTGGGACTATGCCCCCCTGGT<br>GCTGGCCCCTGATGACAGGAGCTACAAGAGCCAGTACCTGAACAATGGCCCCCAGAGGATTGGCAGGAAGTACAAGAAGGTCAGGTTCATGGCCTACA<br>CTGATGAAACCTTCAAGACCAGGGAGGCCATCCAGCATGAGTCTGGCATCCTGGGCCCCCTGCTGTATGGGGAGGTGGGGGACACCCTGCTGATCATC<br>TTCAAGAACCAGGCCAGCAGGCCCTACAACATCTACCCCCATGGCATCACTGATGTGAGGCCCCTGTACAGCAGGAGGCTGCCCAAGGGGGTGAAGCA<br>CCTGAAGGACTTCCCCATCCTGCCTGGGGAGATCTTCAAGTACAAGTGGACTGTGACTGTGGAGGATGGCCCCACCAAGTCTGACCCCAGGTGCCTGA<br>CCAGATACTACAGCAGCTTTGTGAACATGGAGAGGGACCTGGCCTCTGGCCTGATTGGCCCCCTGCTGATCTGCTACAAGGAGTCTGTGGACCAGAGG<br>GGCAACCAGATCATGTCTGACAAGAGGAATGTGATCCTGTTCTCTGTGTTTGATGAGAACAGGAGCTGGTACCTGACTGAGAACATCCAGAGGTTCCT<br>GCCCAACCCTGCTGGGGTGCAGCTGGAGGACCCTGAGTTCCAGGCCAGCAACATCATGCACAGCATCAATGGCTATGTGTTTGACAGCCTGCAGCTGT<br>CTGTGTGCCTGCATGAGGTGGCCTACTGGTACATCCTGAGCATTGGGGCCCAGACTGACTTCCTGTCTGTGTTCTTCTCTGGCTACACCTTCAAGCAC<br>AAGATGGTGTATGAGGACACCCTGACCCTGTTCCCCTTCTCTGGGGAGACTGTGTTCATGAGCATGGAGAACCCTGGCCTGTGGATTCTGGGCTGCCA<br>CAACTCTGACTTCAGGAACAGGGGCATGACTGCCCTGCTGAAAGTCTCCAGCTGTGACAAGAACACTGGGGACTACTATGAGGACAGCTATGAGGACA<br>TCTCTGCCTACCTGCTGAGCAAGAACAATGCCATTGAGCCCAGGAGCTTCAGCCAGAATGCCACTAATGTGTCTAACAACAGCAACACCAGCAATGAC<br>AGCAATGTGTCTCCCCCAGTGCTGAAGAGGCACCAGAGGGAGATCACCAGGACCACCCTGCAGTCTGACCAGGAGGAGATTGACTATGATGACACCAT<br>CTCTGTGGAGATGAAGAAGGAGGACTTTGACATCTACGACGAGGACGAGAACCAGAGCCCCAGGAGCTTCCAGAAGAAGACCAGGCACTACTTCATTG<br>CTGCTGTGGAGAGGCTGTGGGACTATGGCATGAGCAGCAGCCCCCATGTGCTGAGGAACAGGGCCCAGTCTGGCTCTGTGCCCCAGTTCAAGAAGGTG<br>GTGTTCCAGGAGTTCACTGATGGCAGCTTCACCCAGCCCCTGTACAGAGGGGAGCTGAATGAGCACCTGGGCCTGCTGGGCCCCTACATCAGGGCTGA<br>GGTGGAGGACAACATCATGGTGACCTTCAGGAACCAGGCCAGCAGGCCCTACAGCTTCTACAGCAGCCTGATCAGCTATGAGGAGGACCAGAGGCAGG<br>GGGCTGAGCCCAGGAAGAACTTTGTGAAGCCCAATGAAACCAAGACCTACTTCTGGAAGGTGCAGCACCACATGGCCCCCACCAAGGATGAGTTTGAC<br>TGCAAGGCCTGGGCCTACTTCTCTGATGTGGACCTGGAGAAGGATGTGCACTCTGGCCTGATTGGCCCCCTGCTGGTGTGCCACACCAACACCCTGAA<br>CCCTGCCCATGGCAGGCAGGTGACTGTGCAGGAGTTTGCCCTGTTCTTCACCATCTTTGATGAAACCAAGAGCTGGTACTTCACTGAGAACATGGAGA<br>GGAACTGCAGGGCCCCCTGCAACATCCAGATGGAGGACCCCACCTTCAAGGAGAACTACAGGTTCCATGCCATCAATGGCTACATCATGGACACCCTG<br>CCTGGCCTGGTGATGGCCCAGGACCAGAGGATCAGGTGGTACCTGCTGAGCATGGGCAGCAATGAGAACATCCACAGCATCCACTTCTCTGGCCATGT<br>GTTCACTGTGAGGAAGAAGGAGGAGTACAAGATGGCCCTGTACAACCTGTACCCTGGGGTGTTTGAGACTGTGGAGATGCTGCCCAGCAAGGCTGGCA<br>TCTGGAGGGTGGAGTGCCTGATTGGGGAGCACCTGCATGCTGGCATGAGCACCCTGTTCCTGGTGTACAGCAACAAGTGCCAGACCCCCCTGGGCATG<br>GCCTCTGGCCACATCAGGGACTTCCAGATCACTGCCTCTGGCCAGTATGGCCAGTGGGCCCCCAAGCTGGCCAGGCTGCACTACTCTGGCAGCATCAA<br>TGCCTGGAGCACCAAGGAGCCCTTCAGCTGGATCAAGGTGGACCTGCTGGCCCCCATGATCATCCATGGCATCAAGACCCAGGGGGCCAGGCAGAAGT<br>TCAGCAGCCTGTACATCAGCCAGTTCATCATCATGTACAGCCTGGATGGCAAGAAGTGGCAGACCTACAGGGGCAACAGCACTGGCACCCTGATGGTG<br>TTCTTTGGCAATGTGGACAGCTCTGGCATCAAGCACAACATCTTCAACCCCCCCATCATTGCCAGATACATCAGGCTGCACCCCACCCACTACAGCAT<br>CAGGAGCACCCTGAGGATGGAGCTGATGGGCTGTGACCTGAACAGCTGCAGCATGCCCCTGGGCATGGAGAGCAAGGCCATCTCTGATGCCCAGATCA<br>CTGCCAGCAGCTACTTCACCAACATGTTTGCCACCTGGAGCCCCAGCAAGGCCAGGCTGCACCTGCAGGGCAGGAGCAATGCCTGGAGGCCCCAGGTC<br>AACAACCCCAAGGAGTGGCTGCAGGTGGACTTCCAGAAGACCATGAAGGTGACTGGGGTGACCACCCAGGGGGTGAAGAGCCTGCTGACCAGCATGTA |

TABLE 9-continued

| ceDNA Vector Name | Nucleic Acid Sequence |
|---|---|
| | TGTGAAGGAGTTCCTGATCAGCAGCAGCCAGGATGGCCACCAGTGGACCCTGTTCTTCCAGAATGGCAAGGTGAAGGTGTTCCAGGGCAACCAGGACA<br>GCTTCACCCCTGTGGTGAACAGCCTGGACCCCCCCCTGCTGACCAGATACCTGAGGATTCACCCCCAGAGCTGGGTGCACCAGATTGCCCTGAGGATG<br>GAGGTGCTGGGCTGTGAGGCCCAGGACCTGTACTGATTAATTAAGAGCATCTTACCGCCATTTATTCCCATATTTGTTCTGTTTTTCTTGATTTGGGT<br>ATACATTTAAATGTTAATAAAACAAAATGGTGGGGCAATCATTTACATTTTTAGGGATATGTAATTACTAGTTCAGGTGTATTGCCACAAGACAAACA<br>TGTTAAGAAACTTTCCCGTTATTTACGCTCTGTTCCTGTTAATCAACCTCTGGATTACAAAATTTGTGAAAGATTGACTGATATTCTTAACTATGTTG<br>CTCCTTTTACGCTGTGTGGATATGCTGCTTTATAGCCTCTGTATCTAGCTATTGCTTCCCGTACGGCTTTCGTTTTCTCCTCCTTGTATAAATCCTGG<br>TTGCTGTCTCTTTTAGAGGAGTTGTGGCCCGTTGTCCGTCAACGTGGCGTGGTGTGCTCTGTGTTTGCTGACGCAACCCCCACTGGCTGGGGCATTGC<br>CACCACCTGTCAACTCCTTTCTGGGACTTTCGCTTTCCCCCTCCCGATCGCCACGGCAGAACTCATCGCCGCCTGCCTTGCCCGCTGCTGGACAGGGG<br>CTAGGTTGCTGGGCACTGATAATTCCGTGGTGTTGTCTCCATAAAGTAGGAAACACTACACGATTCCATAAAGTAGGAAACACTACATCACTCCATAA<br>AGTAGGAAACACTACATGTGCCTTCTAGTTGCCAGCCATCTGTTGTTTGCCCCTCCCCCGTGCCTTCCTTGACCCTGGAAGGTGCCACTCCCACTGTC<br>CTTTCCTAATAAAATGAGGAAATTGCATCGCATTGTCTGAGTAGGTGTCATTCTATTCTGGGGGGTGGGGTGGGGCAGGACAGCAAGGGGGAGGATTG<br>GGAAGACAATAGCAGGCATGCTGGGGATGCGGTGGGCTCTATGGCTCTAGAGCATGGCTACGTAGATAAGTAGCATGGCGGGTTAATCATTAACTACA<br>CCTGCAGGAGGAACCCCTAGTGATGGAGTTGGCCACTCCCTCTCTGCGCGCTCGCTCGCTCACTGAGGCCGGGCGACCAAAGGTCGCCCGACGCCCGG<br>GCGGCCTCAGTGAGCGAGCGAGCGCGCAGCTGCCTGCAGGGGCGCGCCTCGAGGCATGCGGTACCAAGCTTGTCGAGAAGTACTAGAGGATCATAATC<br>AGCCATACCACATTTGTAGAGGTTTTACTTGCTTTAAAAAACCTCCCACACCTCCCCCTGAACCTGAAACATAAAATGAATGCAATTGTTGTTGTTAA<br>CTTGTTTATTGCAGCTTATAATGGTTACAAATAAAGCAATAGCATCACAAATTTCACAAATAAAGCATTTTTTTCACTGCATTCTAGTTGTGGTTTGT<br>CCAAACTCATCAATGTATCTTATCATGTCTGGATCTGATCACTGATATCGCCTAGGAGATCCGAACCAGATAAGTGAAATCTAGTTCCAAACTATTTT<br>GTCATTTTTAATTTTCGTATTAGCTTACGACGCTACACCCAGTTCCCATCTATTTTGTCACTCTTCCCTAAATAATCCTTAAAAACTCCATTTCCACC<br>CCTCCCAGTTCCCAACTATTTTGTCCGCCCACAGCGGGGCATTTTTCTTCCTGTTATGTTTTTAATCAAACATCCTGCCAACTCCATGTGACAAACCG<br>TCATCTTCGGCTACTTTTTCTCTGTCACAGAATGAAAATTTTTCTGTCATCTCTTCGTTATTAATGTTTGTAATTGACTGAATATCAACGCTTATTTG<br>CAGCCTGAATGGCGAATGGGACGCGCCCTGTAGCGGCGCATTAAGCGCGGCGGGTGTGGTGGTTACGCGCAGCGTGACCGCTACACTTGCCAGCGCCC<br>TAGCGCCCGCTCCTTTCGCTTTCTTCCCTTCCTTTCTCGCCACGTTCGCCGGCTTTCCCCGTCAAGCTCTAAATCGGGGGCTCCCTTTAGGGTTCCGA<br>TTTAGTGCTTTACGGCACCTCGACCCCAAAAAACTTGATTAGGGTGATGGTTCACGTAGTGGGCCATCGCCCTGATAGACGGTTTTTCGCCCTTTGAC<br>GTTGGAGTCCACGTTCTTTAATAGTGGACTCTTGTTCCAAACTGGAACAACACTCAACCCTATCTCGGTCTATTCTTTTGATTTATAAGGGATTTTGC<br>CGATTTCGGCCTATTGGTTAAAAAATGAGCTGATTTAACAAAAATTTAACGCGAATTTTAACAAAATATTAACGTTTACAATTTCAGGTGGCACTTTT<br>CGGGGAAATGTGCGCGGAACCCCTATTTGTTTATTTTTCTAAATACATTCAAATATGTATCCGCTCATGAGACAATAACCCTGATAAATGCTTCAATA<br>ATATTGAAAAAGGAAGAGTATGAGTATTCAACATTTCCGTGTCGCCCTTATTCCCTTTTTTGCGGCATTTTGCCTTCCTGTTTTTGCTCACCCAGAAA<br>CGCTGGTGAAAGTAAAAGATGCTGAAGATCAGTTGGGTGCACGAGTGGGTTACATCGAACTGGATCTCAACAGCGGTAAGATCCTTGAGAGTTTTCGC<br>CCCGAAGAACGTTTTCCAATGATGAGCACTTTTAAAGTTCTGCTATGTGGCGCGGTATTATCCCGTATTGACGCCGGGCAAGAGCAACTCGGTCGCCG<br>CATACACTATTCTCAGAATGACTTGGTTGAGTACTCACCAGTCACAGAAAAGCATCTTACGGATGGCATGACAGTAAGAGAATTATGCAGTGCTGCCA<br>TAACCATGAGTGATAACACTGCGGCCAACTTACTTCTGACAACGATCGGAGGACCGAAGGAGCTAACCGCTTTTTTGCACAACATGGGGGATCATGTA<br>ACTCGCCTTGATCGTTGGGAACCGGAGCTGAATGAAGCCATACCAAACGACGAGCGTGACACCACGATGCCTGTAGCAATGGCAACAACGTTGCGCAA<br>ACTATTAACTGGCGAACTACTTACTCTAGCTTCCCGGCAACAATTAATAGACTGGATGGAGGCGGATAAAGTTGCAGGACCACTTCTGCGCTCGGCCC<br>TTCCGGCTGGCTGGTTTATTGCTGATAAATCTGGAGCCGGTGAGCGTGGGTCTCGCGGTATCATTGCAGCACTGGGGCCAGATGGTAAGCCCTCCCGT<br>ATCGTAGTTATCTACACGACGGGGAGTCAGGCAACTATGGATGAACGAAATAGACAGATCGCTGAGATAGGTGCCTCACTGATTAAGCATTGGTAACT<br>GTCAGACCAAGTTTACTCATATATACTTTAGATTGATTTAAAACTTCATTTTTAATTTAAAAGGATCTAGGTGAAGATCCTTTTTGATAATCTCATGA<br>CCAAAATCCCTTAACGTGAGTTTTCGTTCCACTGAGCGTCAGACCCCGTAGAAAAGATCAAAGGATCTTCTTGAGATCCTTTTTTTCTGCGCGTAATC<br>TGCTGCTTGCAAACAAAAAAACCACCGCTACCAGCGGTGGTTTGTTTGCCGGATCAAGAGCTACCAACTCTTTTTCCGAAGGTAACTGGCTTCAGCAG<br>AGCGCAGATACCAAATACTGTCCTTCTAGTGTAGCCGTAGTTAGGCCACCACTTCAAGAACTCTGTAGCACCGCCTACATACCTCGCTCTGCTAATCC<br>TGTTACCAGTGGCTGCTGCCAGTGGCGATAAGTCGTGTCTTACCGGGTTGGACTCAAGACGATAGTTACCGGATAAGGCGCAGCGGTCGGGCTGAACG<br>GGGGGTTCGTGCACACAGCCCAGCTTGGAGCGAACGACCTACACCGAACTGAGATACCTACAGCGTGAGCATTGAGAAAGCGCCACGCTTCCCGAAGG<br>GAGAAAGGCGGACAGGTATCCGGTAAGCGGCAGGGTCGGAACAGGAGAGCGCACGAGGGAGCTTCCAGGGGGAAACGCCTGGTATCTTTATAGTCCTG<br>TCGGGTTTCGCCACCTCTGACTTGAGCGTCGATTTTTGTGATGCTCGTCAGGGGGGCGGAGCCTATGGAAAAACGCCAGCAACGCGGCCTTTTTACGG<br>TTCCTGGCCTTTTGCTGGCCTTTTGCTCACATGTTCTTTCCTGCGTTATCCCCTGATTCTGTGGATAACCGTATTACCGCCTTTGAGTGAGCTGATAC<br>CGCTCGCCGCAGCCGAACGACCGAGCGCAGCGAGTCAGTGAGCGAGGAAGCGGAAGAGCGCCTGATGCGGTATTTTCTCCTTACGCATCTGTGCGGTA<br>TTTCACACCGCAGACCAGCCGCGTAACCTGGCAAAATCGGTTACGGTTGAGTAATAAATGGATGCCCTGCGTAAGCGGGTGTGGGCGGACAATAAAGT<br>CTTAAACTGAACAAAATAGATCTAAACTATGACAATAAAGTCTTAAACTAGACAGAATAGTTGTAAACTGAAATCAGTCCAGTTATGCTGTGAAAAAG<br>CATACTGGACTTTTGTTATGGCTAAAGCAAACTCTTCATTTTCTGAAGTGCAAATTGCCCGTCGTATTAAAGAGGGGCGTGGCCAAGGGCATGGTAAA<br>GACTATATTCGCGGCGTTGTGACAATTTACCGAACAACTCCGCGGCCGGGAAGCCGATCTCGGCTTGAACGAATTGTTAGGTGGCGGTACTTGGGTCG<br>ATATCAAAGTGCATCACTTCTTCCCGTATGCCCAACTTTGTATAGAGAGCCACTGCGGGATCGTCACCGTAATCTGCTTGCACGTAGATCACATAAGC |

TABLE 9-continued

| ceDNA Vector Name | Nucleic Acid Sequence |
|---|---|
| | ACCAAGCGCGTTGGCCTCATGCTTGAGGAGATTGATGAGCGCGGTGGCAATGCCCTGCCTCCGGTGCTCGCCGGAGACTGCGAGATCATAGATATAGA<br>TCTCACTACGCGGCTGCTCAAACCTGGGCAGAACGTAAGCCGCGAGAGCGCCAACAACCGCTTCTTGGTCGAAGGCAGCAAGCGCGATGAATGTCTTA<br>CTACGGAGCAAGTTCCCGAGGTAATCGGAGTCCGGCTGATGTTGGGAGTAGGTGGCTACGTCTCCGAACTCACGACCGAAAAGATCAAGAGCAGCCCG<br>CATGGATTTGACTTGGTCAGGGCCGAGCCTACATGTGCGAATGATGCCCATACTTGAGCCACCTAACTTTGTTTTAGGGCGACTGCCCTGCTGCGTAA<br>CATCGTTGCTGCTGCGTAACATCGTTGCTGCTCCATAACATCAAACATCGACCCACGGCGTAACGCGCTTGCTGCTTGGATGCCCGAGGCATAGACTG<br>TACAAAAAAACAGTCATAACAAGCCATGAAAACCGCCACTGCGCCGTTACCACCGCTGCGTTCGGTCAAGGTTCTGGACCAGTTGCGTGAGCGCATAC<br>GCTACTTGCATTACAGTTTACGAACCGAACAGGCTTATGTCAACTGGGTTCGTGCCTTCATCCGTTTCCACGGTGTGCGTCACCCGGCAACCTTGGGC<br>AGCAGCGAAGTCGAGGCATTTCTGTCCTGGCTGGCGAACGAGCGCAAGGTTTCGGTCTCCACGCATCGTCAGGCATTGGCGGCCTTGCTGTTCTTCTA<br>CGGCAAGGTGCTGTGCACGGATCTGCCCTGGCTTCAGGAGATCGGAAGACCTCGGCCGTCGCGGCGCTTGCCGGTGGTGCTGACCCCGGATGAAGTGG<br>TTCGCATCCTCGGTTTTCTGGAAGGCGAGCATCGTTTGTTCGCCCAGGACTCTAGCTATAGTTCTAGTGGTTGGCTACGTATACTCCGGAATATTAAT<br>AGATCATGGAGATAATTAAAATGATAACCATCTCGCAAATAAATAAGTATTTTACTGTTTTCGTAACAGTTTTGTAATAAAAAAACCTATAAATATTC<br>CGGATTATTCATACCGTCCCACCATCGGGCGCGGATCTCGGTCCGAAACCATGTCGTACTACCATCACCATCACCATCACGATTACGATATCCCAACG<br>ACCGAAAACCTGTATTTTCAGGGCGCCATGGGATCC |
| ceDNAFVII-vector 18 (SEQ ID NO: 209) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGA**CGGGGGAGGCTGCTGGTGAATATTAACCAAGGTCACCCCAGTTATCGGAGGAGCAAACAGGGGCTAAGTCCACACGCGTGGTACCGTCTGTC**<br>**TGCACATTTCGTAGAGCGAGTGTTCCGATACTCTAATCTCCCTAGGCAAGGTTCATATTTGTGTAGGTTACTTATTCTCCTTTTGTTGACTAAGTCAA**<br>**TAATCAGAATCAGCAGGTTTGGAGTCAGCTTGGCAGGGATCAGCAGCCTGGGTTGGAAGGAGGGG**GTATAAAAGCCCCTTCACCAGGAGAAGCCGTCA<br>CACAGATCCACAAGCTCCTGAAGAGGTAAGGGTTTAAGGGATGGTTGGTTGGTGGGGTATTAATGTTTAATTACCTGGAGCACCTGCCTGAAATCACT<br>TTTTTTCAGGTTGGTTTAAACGCCGCCACCATGCAGATCGAGCTGTCTACCTGCTTCTTCCTGTGCCTGCTGCGGTTCTGCTTCAGCGCCACCAGAAG<br>ATATTACCTGGGCGCCGTGGAACTGAGCTGGGACTACATGCAGTCTGACCTGGGAGAGCTGCCCGTGGACGCTAGATTTCCTCCAAGAGTGCCCAAGA<br>GCTTCCCCTTCAACACCTCCGTGGTGTACAAGAAAACCCTGTTCGTGGAATTCACCGACCACCTGTTCAATATCGCCAAGCCTCGGCCTCCTTGGATG<br>GGACTGCTGGGACCTACAATTCAGGCCGAGGTGTACGACACCGTGGTCATCACCCTGAAGAACATGGCCAGCCATCCTGTGTCTCTGCACGCCGTGGG<br>AGTGTCTTATTGGAAGGCTTCTGAGGGCGCCGAGTACGACGATCAGACAAGCCAGAGAGAGAAAGAGGACGACAAGGTTTTCCCTGGCGGCAGCCACA<br>CCTATGTCTGGCAGGTCCTGAAAGAAAACGGCCCTATGGCCTCCGATCCTCTGTGCCTGACATACAGCTACCTGAGCCACGTGGACCTGGTCAAGGAC<br>CTGAATTCTGGCCTGATCGGAGCCCTGCTCGTGTGTAGAGAAGGCAGCCTGGCCAAAGAGAAAACCCAGACACTGCACAAGTTCATCCTGCTGTTCGC<br>CGTGTTCGACGAGGGCAAGAGCTGGCACAGCGAGACAAAGAACAGCCTGATGCAGGACAGGGATGCCGCCTCTGCTAGAGCTTGGCCTAAGATGCACA<br>CCGTGAACGGCTACGTGAACAGAAGCCTGCCTGGACTGATCGGCTGCCACAGAAAGTCCGTGTACTGGCACGTGATCGGCATGGGCACAACACCTGAG<br>GTGCACAGCATCTTTCTGGAAGGCCACACCTTCCTCGTGCGGAACCACAGACAGGCCAGCCTGGAAATCAGCCCTATCACCTTCCTGACCGCTCAGAC<br>CCTGCTGATGGATCTGGGCCAGTTTCTGCTGTTCTGCCACATCAGCTCCCACCAGCACGATGGCATGGAAGCCTACGTGAAGGTGGACAGCTGCCCCG<br>AAGAACCCCAGCTGCGGATGAAGAACAACGAGGAAGCCGAGGACTACGACGACGACCTGACCGACTCTGAGATGGACGTCGTCAGATTCGACGACGAT<br>AACAGCCCCAGCTTCATCCAGATCAGAAGCGTGGCCAAGAAGCACCCCAAGACCTGGGTGCACTATATCGCCGCCGAGGAAGAGGACTGGGATTACGC<br>TCCTCTGGTGCTGGCCCCTGACGACAGAAGCTACAAGAGCCAGTACCTGAACAACGGCCCTCAGCGGATCGGCCGGAAGTATAAGAAAGTGCGGTTCA<br>TGGCCTACACCGACGAGACATTCAAGACCAGAGAGGCCATCCAGCACGAGAGCGGAATTCTGGGCCCTCTGCTGTATGGCGAAGTGGGCGATACACTG<br>CTGATCATCTTCAAGAACCAGGCCAGCAGACCCTACAACATCTACCCTCACGGCATCACCGATGTGCGGCCCCTGTATTCTAGAAGGCTGCCCAAGGG<br>CGTGAAGCACCTGAAGGACTTCCCTATCCTGCCTGGCGAGATTTTCAAGTACAAGTGGACCGTGACCGTGGAAGATGGCCCCACCAAGAGCGACCCTA<br>GATGTCTGACACGGTACTACAGCAGCTTCGTGAACATGGAACGCGACCTGGCCAGCGGCCTGATTGGACCTCTGCTGATCTGCTACAAAGAAAGCGTG<br>GACCAGCGGGGCAACCAGATCATGAGCGACAAGCGGAACGTGATCCTGTTTAGCGTGTTCGATGAGAACCGGTCCTGGTATCTGACCGAGAACATCCA<br>GCGGTTTCTGCCCAATCCTGCCGGGGTGCAACTGGAAGATCCTGAGTTCCAGGCAAGCAACATCATGCACTCCATCAATGGCTATGTGTTCGACAGCC<br>TGCAGCTGAGCGTGTGCCTGCACGAAGTGGCCTACTGGTACATCCTGAGCATTGGCGCCCAGACCGACTTCCTGTCCGTGTTCTTTAGCGGCTACACC<br>TTCAAGCACAAGATGGTGTACGAGGATACCCTGACACTGTTCCCATTCAGCGGCGAGACAGTGTTCATGAGCATGGAAAACCCCGGCCTGTGGATTCT<br>GGGCTGTCACAACAGCGACTTCCGGAACAGAGGCATGACAGCCCTGCTGAAGGTGTCCAGCTGCGACAAGAACACCGGCGACTACTACGAGGACAGCT<br>ATGAGGACATCAGCGCCTACCTGCTGAGCAAGAACAATGCCATCGAGCCTCGGAGCTTCAGCCAGAATCCTCCTGTGCTGAAGCGGCACCAGCGCGAG<br>ATCACCAGAACAACCCTGCAGAGCGACCAAGAGGAAATCGATTACGACGACACCATCAGCGTCGAGATGAAGAAAGAAGATTTCGACATCTACGACGA<br>GGACGAGAATCAGAGCCCCAGAAGCTTTCAGAAAAAGACCCGGCACTACTTCATTGCCGCCGTCGAGAGACTGTGGGACTACGGCATGTCTAGCAGCC<br>CTCACGTGCTGAGAAATAGAGCCCAGAGCGGCAGCGTGCCCCAGTTCAAGAAAGTGGTGTTCCAAGAGTTCACCGACGGCAGCTTCACCCAGCCACTG<br>TATAGAGGCGAGCTGAACGAGCATCTGGGCCTGCTGGGCCCTTATATCAGAGCCGAAGTGGAAGATAACATCATGGTCACCTTCCGGAATCAGGCTAG<br>CCGGCCTTACAGCTTCTACAGCTCCCTGATCAGCTACGAAGAGGACCAGAGACAGGGCGCTGAGCCCAGAAAGAACTTCGTGAAGCCCAACGAGACTA<br>AGACCTACTTTTGGAAGGTGCAGCACCACATGGCCCCTACAAAGGACGAGTTCGACTGCAAAGCCTGGGCCTACTTCTCCGATGTGGATCTGGAAAAG |

TABLE 9-continued

| ceDNA Vector Name | Nucleic Acid Sequence |
|---|---|
| | GACGTGCACAGCGGGCTCATCGGACCACTGCTTGTGTGCCACACCAACACACTGAACCCCGCTCACGGCAGACAAGTGACAGTGCAAGAGTTCGCCCT |
| | GTTCTTCACCATCTTCGACGAAACAAAGAGCTGGTACTTCACCGAGAATATGGAACGGAACTGCAGAGCCCCTTGCAACATCCAGATGGAAGATCCCA |
| | CCTTCAAAGAGAACTACCGGTTCCACGCCATCAACGGCTACATCATGGACACACTGCCCGGCCTGGTTATGGCCCAGGATCAGAGAATCCGGTGGTAT |
| | CTGCTGTCCATGGGCTCCAACGAGAATATCCACAGCATCCACTTCAGCGGCCACGTGTTCACCGTGCGGAAAAAAGAAGAGTACAAAATGGCCCTGTA |
| | CAATCTGTACCCTGGGGTGTTCGAAACCGTGGAAATGCTGCCTTCCAAGGCCGGCATTTGGAGAGTGGAATGTCTGATTGGAGAGCACCTCCACGCCG |
| | GAATGAGCACCCTGTTTCTGGTGTACAGCAACAAGTGTCAGACCCCTCTCGGCATGGCCTCTGGACACATCAGAGACTTCCAGATCACCGCCTCTGGC |
| | CAGTACGGACAGTGGGCTCCTAAACTGGCTCGGCTGCACTACAGCGGCAGCATCAATGCCTGGTCCACCAAAGAGCCCTTCAGCTGGATCAAGGTGGA |
| | CCTGCTGGCTCCCATGATCATCCACGGAATCAAGACCCAGGGCGCCAGACAGAAGTTCAGCAGCCTGTACATCAGCCAGTTCATCATCATGTACAGCC |
| | TGGACGGCAAGAAGTGGCAGACCTACAGAGGCAACAGCACCGGCACACTCATGGTGTTCTTCGGCAACGTGGACTCCAGCGGCATTAAGCACAACATC |
| | TTCAACCCTCCAATCATTGCCCGGTACATCCGGCTGCACCCCACACACTACAGCATCCGGTCTACCCTGAGAATGGAACTGATGGGCTGCGACCTGAA |
| | CAGCTGCTCTATGCCCCTCGGAATGGAAAGCAAGGCCATCAGCGACGCCCAGATCACAGCCAGCAGCTACTTCACCAACATGTTCGCCACTTGGAGCC |
| | CCTCCAAGGCTAGACTGCATCTGCAGGGCAGAAGCAACGCTTGGAGGCCCCAAGTGAACAACCCCAAAGAGTGGCTGCAGGTTGACTTTCAAAAGACC |
| | ATGAAAGTGACCGGCGTGACCACACAGGGCGTCAAGTCTCTGCTGACCTCTATGTACGTGAAAGAGTTCCTGATCTCCAGCAGCCAGGACGGCCATCA |
| | GTGGACCCTGTTTTTCCAGAACGGCAAAGTGAAAGTGTTCCAGGGCAATCAGGACAGCTTCACACCCGTGGTCAATTCTCTGGACCCTCCACTGCTGA |
| | CCAGATACCTGCGGATTCACCCTCAGTCTTGGGTGCACCAGATCGCTCTGCGGATGGAAGTGCTGGGCTGTGAAGCTCAGGACCTCTACTAGTTAATT |
| | AAGAGCATCTTACCGCCATTTATTCCCATATTTGTTCTGTTTTTCTTGATTTGGGTATACATTTAAATGTTAATAAAACAAAATGGTGGGGCAATCAT |
| | TTACATTTTTAGGGATATGTAATTACTAGTTCAGGTGTATTGCCACAAGACAAACATGTTAAGAAACTTTCCCGTTATTTACGCTCTGTTCCTGTTAA |
| | TCAACCTCTGGATTACAAAATTTGTGAAAGATTGACTGATATTCTTAACTATGTTGCTCCTTTTACGCTGTGTGGATATGCTGCTTTATAGCCTCTGT |
| | ATCTAGCTATTGCTTCCCGTACGGCTTTCGTTTTCTCCTCCTTGTATAAATCCTGGTTGCTGTCTCTTTTAGAGGAGTTGTGGCCCGTTGTCCGTCAA |
| | CGTGGCGTGGTGTGCTCTGTGTTTGCTGACGCAACCCCCACTGGCTGGGGCATTGCCACCACCTGTCAACTCCTTTCTGGGACTTTCGCTTTCCCCCT |
| | CCCGATCGCCACGGCAGAACTCATCGCCGCCTGCCTTGCCCGCTGCTGGACAGGGGCTAGGTTGCTGGGCACTGATAATTCCGTGGTGTTGTCTGTGC |
| | CTTCTAGTTGCCAGCCATCTGTTGTTTGCCCCTCCCCCGTGCCTTCCTTGACCCTGGAAGGTGCCACTCCCACTGTCCTTTCCTAATAAAATGAGGAA |
| | ATTGCATCGCATTGTCTGAGTAGGTGTCATTCTATTCTGGGGGGTGGGGTGGGGCAGGACAGCAAGGGGGAGGATTGGGAAGACAATAGCAGGCATGC |
| | TGGGGATGCGGTGGGCTCTATGGCTCTAGAGCATGGCTACGTAGATAAGTAGCATGGCGGGTTAATCATTAACTACACCTGCAGGAGGAACCCCTAGT |
| | GATGGAGTTGGCCACTCCCTCTCTGCGCGCTCGCTCGCTCACTGAGGCCGGGCGACCAAAGGTCGCCCGACGCCCGGGCGGCCTCAGTGAGCGAGCGA |
| | GCGCGCAGCTGCCTGCAGGGGCGCGCCTCGAGGCATGCGGTACCAAGCTTGTCGAGAAGTACTAGAGGATCATAATCAGCCATACCACATTTGTAGAG |
| | GTTTTACTTGCTTTAAAAAACCTCCCACACCTCCCCCTGAACCTGAAACATAAAATGAATGCAATTGTTGTTGTTAACTTGTTTATTGCAGCTTATAA |
| | TGGTTACAAATAAAGCAATAGCATCACAAATTTCACAAATAAAGCATTTTTTTCACTGCATTCTAGTTGTGGTTTGTCCAAACTCATCAATGTATCTT |
| | ATCATGTCTGGATCTGATCACTGATATCGCCTAGGAGATCCGAACCAGATAAGTGAAATCTAGTTCCAAACTATTTTGTCATTTTTAATTTTCGTATT |
| | AGCTTACGACGCTACACCCAGTTCCCATCTATTTTGTCACTCTTCCCTAAATAATCCTTAAAAACTCCATTTCCACCCCTCCCAGTTCCCAACTATTT |
| | TGTCCGCCCACAGCGGGGCATTTTTCTTCCTGTTATGTTTTTAATCAAACATCCTGCCAACTCCATGTGACAAACCGTCATCTTCGGCTACTTTTTCT |
| | CTGTCACAGAATGAAAATTTTTCTGTCATCTCTTCGTTATTAATGTTTGTAATTGACTGAATATCAACGCTTATTTGCAGCCTGAATGGCGAATGGGA |
| | CGCGCCCTGTAGCGGCGCATTAAGCGCGGCGGGTGTGGTGGTTACGCGCAGCGTGACCGCTACACTTGCCAGCGCCCTAGCGCCCGCTCCTTTCGCTT |
| | TCTTCCCTTCCTTTCTCGCCACGTTCGCCGGCTTTCCCCGTCAAGCTCTAAATCGGGGGCTCCCTTTAGGGTTCCGATTTAGTGCTTTACGGCACCTC |
| | GACCCCAAAAAACTTGATTAGGGTGATGGTTCACGTAGTGGGCCATCGCCCTGATAGACGGTTTTTCGCCCTTTGACGTTGGAGTCCACGTTCTTTAA |
| | TAGTGGACTCTTGTTCCAAACTGGAACAACACTCAACCCTATCTCGGTCTATTCTTTTGATTTATAAGGGATTTTGCCGATTTCGGCCTATTGGTTAA |
| | AAAATGAGCTGATTTAACAAAAATTTAACGCGAATTTTAACAAAATATTAACGTTTACAATTTCAGGTGGCACTTTTCGGGGAAATGTGCGCGGAACC |
| | CCTATTTGTTTATTTTTCTAAATACATTCAAATATGTATCCGCTCATGAGACAATAACCCTGATAAATGCTTCAATAATATTGAAAAAGGAAGAGTAT |
| | GAGTATTCAACATTTCCGTGTCGCCCTTATTCCCTTTTTTGCGGCATTTTGCCTTCCTGTTTTTGCTCACCCAGAAACGCTGGTGAAAGTAAAAGATG |
| | CTGAAGATCAGTTGGGTGCACGAGTGGGTTACATCGAACTGGATCTCAACAGCGGTAAGATCCTTGAGAGTTTTCGCCCCGAAGAACGTTTTCCAATG |
| | ATGAGCACTTTTAAAGTTCTGCTATGTGGCGCGGTATTATCCCGTATTGACGCCGGGCAAGAGCAACTCGGTCGCCGCATACACTATTCTCAGAATGA |
| | CTTGGTTGAGTACTCACCAGTCACAGAAAAGCATCTTACGGATGGCATGACAGTAAGAGAATTATGCAGTGCTGCCATAACCATGAGTGATAACACTG |
| | CGGCCAACTTACTTCTGACAACGATCGGAGGACCGAAGGAGCTAACCGCTTTTTTGCACAACATGGGGGATCATGTAACTCGCCTTGATCGTTGGGAA |
| | CCGGAGCTGAATGAAGCCATACCAAACGACGAGCGTGACACCACGATGCCTGTAGCAATGGCAACAACGTTGCGCAAACTATTAACTGGCGAACTACT |
| | TACTCTAGCTTCCCGGCAACAATTAATAGACTGGATGGAGGCGGATAAAGTTGCAGGACCACTTCTGCGCTCGGCCCTTCCGGCTGGCTGGTTTATTG |
| | CTGATAAATCTGGAGCCGGTGAGCGTGGGTCTCGCGGTATCATTGCAGCACTGGGGCCAGATGGTAAGCCCTCCCGTATCGTAGTTATCTACACGACG |
| | GGGAGTCAGGCAACTATGGATGAACGAAATAGACAGATCGCTGAGATAGGTGCCTCACTGATTAAGCATTGGTAACTGTCAGACCAAGTTTACTCATA |
| | TATACTTTAGATTGATTTAAAACTTCATTTTTAATTTAAAAGGATCTAGGTGAAGATCCTTTTTGATAATCTCATGACCAAAATCCCTTAACGTGAGT |
| | TTTCGTTCCACTGAGCGTCAGACCCCGTAGAAAAGATCAAAGGATCTTCTTGAGATCCTTTTTTTCTGCGCGTAATCTGCTGCTTGCAAACAAAAAAA |
| | CCACCGCTACCAGCGGTGGTTTGTTTGCCGGATCAAGAGCTACCAACTCTTTTTCCGAAGGTAACTGGCTTCAGCAGAGCGCAGATACCAAATACTGT |

TABLE 9-continued

| ceDNA Vector Name | Nucleic Acid Sequence |
|---|---|
| | CCTTCTAGTGTAGCCGTAGTTAGGCCACCACTTCAAGAACTCTGTAGCACCGCCTACATACCTCGCTCTGCTAATCCTGTTACCAGTGGCTGCTGCCA<br>GTGGCGATAAGTCGTGTCTTACCGGGTTGGACTCAAGACGATAGTTACCGGATAAGGCGCAGCGGTCGGGCTGAACGGGGGGTTCGTGCACACAGCCC<br>AGCTTGGAGCGAACGACCTACACCGAACTGAGATACCTACAGCGTGAGCATTGAGAAAGCGCCACGCTTCCCGAAGGGAGAAAGGCGGACAGGTATCC<br>GGTAAGCGGCAGGGTCGGAACAGGAGAGCGCACGAGGGAGCTTCCAGGGGGAAACGCCTGGTATCTTTATAGTCCTGTCGGGTTTCGCCACCTCTGAC<br>TTGAGCGTCGATTTTTGTGATGCTCGTCAGGGGGGCGGAGCCTATGGAAAAACGCCAGCAACGCGGCCTTTTTACGGTTCCTGGCCTTTTGCTGGCCT<br>TTTGCTCACATGTTCTTTCCTGCGTTATCCCCTGATTCTGTGGATAACCGTATTACCGCCTTTGAGTGAGCTGATACCGCTCGCCGCAGCCGAACGAC<br>CGAGCGCAGCGAGTCAGTGAGCGAGGAAGCGGAAGAGCGCCTGATGCGGTATTTTCTCCTTACGCATCTGTGCGGTATTTCACACCGCAGACCAGCCG<br>CGTAACCTGGCAAAATCGGTTACGGTTGAGTAATAAATGGATGCCCTGCGTAAGCGGGTGTGGGCGGACAATAAAGTCTTAAACTGAACAAAATAGAT<br>CTAAACTATGACAATAAAGTCTTAAACTAGACAGAATAGTTGTAAACTGAAATCAGTCCAGTTATGCTGTGAAAAAGCATACTGGACTTTTGTTATGG<br>CTAAAGCAAACTCTTCATTTTCTGAAGTGCAAATTGCCCGTCGTATTAAAGAGGGGCGTGGCCAAGGGCATGGTAAAGACTATATTCGCGGCGTTGTG<br>ACAATTTACCGAACAACTCCGCGGCCGGGAAGCCGATCTCGGCTTGAACGAATTGTTAGGTGGCGGTACTTGGGTCGATATCAAAGTGCATCACTTCT<br>TCCCGTATGCCCAACTTTGTATAGAGAGCCACTGCGGGATCGTCACCGTAATCTGCTTGCACGTAGATCACATAAGCACCAAGCGCGTTGGCCTCATG<br>CTTGAGGAGATTGATGAGCGCGGTGGCAATGCCCTGCCTCCGGTGCTCGCCGGAGACTGCGAGATCATAGATATAGATCTCACTACGCGGCTGCTCAA<br>ACCTGGGCAGAACGTAAGCCGCGAGAGCGCCAACAACCGCTTCTTGGTCGAAGGCAGCAAGCGCGATGAATGTCTTACTACGGAGCAAGTTCCCGAGG<br>TAATCGGAGTCCGGCTGATGTTGGGAGTAGGTGGCTACGTCTCCGAACTCACGACCGAAAAGATCAAGAGCAGCCCGCATGGATTTGACTTGGTCAGG<br>GCCGAGCCTACATGTGCGAATGATGCCCATACTTGAGCCACCTAACTTTGTTTTAGGGCGACTGCCCTGCTGCGTAACATCGTTGCTGCTGCGTAACA<br>TCGTTGCTGCTCCATAACATCAAACATCGACCCACGGCGTAACGCGCTTGCTGCTTGGATGCCCGAGGCATAGACTGTACAAAAAAACAGTCATAACA<br>AGCCATGAAAACCGCCACTGCGCCGTTACCACCGCTGCGTTCGGTCAAGGTTCTGGACCAGTTGCGTGAGCGCATACGCTACTTGCATTACAGTTTAC<br>GAACCGAACAGGCTTATGTCAACTGGGTTCGTGCCTTCATCCGTTTCCACGGTGTGCGTCACCCGGCAACCTTGGGCAGCAGCGAAGTCGAGGCATTT<br>CTGTCCTGGCTGGCGAACGAGCGCAAGGTTTCGGTCTCCACGCATCGTCAGGCATTGGCGGCCTTGCTGTTCTTCTACGGCAAGGTGCTGTGCACGGA<br>TCTGCCCTGGCTTCAGGAGATCGGAAGACCTCGGCCGTCGCGGCGCTTGCCGGTGGTGCTGACCCCGGATGAAGTGGTTCGCATCCTCGGTTTTCTGG<br>AAGGCGAGCATCGTTTGTTCGCCCAGGACTCTAGCTATAGTTCTAGTGGTTGGCTACGTATACTCCGGAATATTAATAGATCATGGAGATAATTAAAA<br>TGATAACCATCTCGCAAATAAATAAGTATTTTACTGTTTTCGTAACAGTTTTGTAATAAAAAAACCTATAAATATTCCGGATTATTCATACCGTCCCA<br>CCATCGGGCGCGGATCTCGGTCCGAAACCATGTCGTACTACCATCACCATCACCATCACGATTACGATATCCCAACGACCGAAAACCTGTATTTTCAG<br>GGCGCCATGGGATCC |
| ceDNAFVIII-vector 19 (SEQ ID NO: 210) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGA**CGGGGGAGGCTGCTGGTGAATATTAACCAAGGTCACCCCAGTTATCGGAGGAGCAAACAGGGGCTAAGTCCACACGCGTGGTACCGTCTGTC**<br>**TGCACATTTCGTAGAGCGAGTGTTCCGATACTCTAATCTCCCTAGGCAAGGTTCATATTTGTGTAGGTTACTTATTCTCCTTTTGTTGACTAAGTCAA**<br>**TAATCAGAATCAGCAGGTTTGGAGTCAGCTTGGCAGGGATCAGCAGCCTGGGTTGGAAGGAGGGG**GTATAAAAGCCCCTTCACCAGGAGAAGCCGTCA<br>CACAGATCCACAAGCTCCTGAAGAGGTAAGGGTTTAAGGGATGGTTGGTTGGTGGGGTATTAATGTTTAATTACCTGGAGCACCTGCCTGAAATCACT<br>TTTTTTCAGGTTGGTTTAAACGCCGCCACCATGCAGATTGAGCTGAGCACCTGCTTCTTCCTGTGCCTGCTGAGGTTCTGCTTCTCTGCCACCAGGAG<br>ATACTACCTGGGGGCTGTGGAGCTGAGCTGGGACTACATGCAGTCTGACCTGGGGGAGCTGCCTGTGGATGCCAGGTTCCCCCCCAGAGTGCCCAAGA<br>GCTTCCCCTTCAACACCTCTGTGGTGTACAAGAAGACCCTGTTTGTGGAGTTCACTGACCACCTGTTCAACATTGCCAAGCCCAGGCCCCCCTGGATG<br>GGCCTGCTGGGCCCCACCATCCAGGCTGAGGTGTATGACACTGTGGTGATCACCCTGAAGAACATGGCCAGCCACCCTGTGAGCCTGCATGCTGTGGG<br>GGTGAGCTACTGGAAGGCCTCTGAGGGGGCTGAGTATGATGACCAGACCAGCCAGAGGGAGAAGGAGGATGACAAGGTGTTCCCTGGGGGCAGCCACA<br>CCTATGTGTGGCAGGTGCTGAAGGAGAATGGCCCCATGGCCTCTGACCCCCTGTGCCTGACCTACAGCTACCTGAGCCATGTGGACCTGGTGAAGGAC<br>CTGAACTCTGGCCTGATTGGGGCCCTGCTGGTGTGCAGGGAGGGCAGCCTGGCCAAGGAGAAGACCCAGACCCTGCACAAGTTCATCCTGCTGTTTGC<br>TGTGTTTGATGAGGGCAAGAGCTGGCACTCTGAAACCAAGAACAGCCTGATGCAGGACAGGGATGCTGCCTCTGCCAGGGCCTGGCCCAAGATGCACA<br>CTGTGAATGGCTATGTGAACAGGAGCCTGCCTGGCCTGATTGGCTGCCACAGGAAGTCTGTGTACTGGCATGTGATTGGCATGGGCACCACCCCTGAG<br>GTGCACAGCATCTTCCTGGAGGGCCACACCTTCCTGGTCAGGAACCACAGGCAGGCCAGCCTGGAGATCAGCCCCATCACCTTCCTGACTGCCCAGAC<br>CCTGCTGATGGACCTGGGCCAGTTCCTGCTGTTCTGCCACATCAGCAGCCACCAGCATGATGGCATGGAGGCCTATGTGAAGGTGGACAGCTGCCCTG<br>AGGAGCCCCAGCTGAGGATGAAGAACAATGAGGAGGCTGAGGACTATGATGATGACCTGACTGACTCTGAGATGGATGTGGTGAGGTTTGATGATGAC<br>AACAGCCCCAGCTTCATCCAGATCAGGTCTGTGGCCAAGAAGCACCCCAAGACCTGGGTGCACTACATTGCTGCTGAGGAGGAGGACTGGGACTATGC<br>CCCCCTGGTGCTGGCCCCTGATGACAGGAGCTACAAGAGCCAGTACCTGAACAATGGCCCCCAGAGGATTGGCAGGAAGTACAAGAAGGTCAGGTTCA<br>TGGCCTACACTGATGAAACCTTCAAGACCAGGGAGGCCATCCAGCATGAGTCTGGCATCCTGGGCCCCCTGCTGTATGGGGAGGTGGGGGACACCCTG<br>CTGATCATCTTCAAGAACCAGGCCAGCAGGCCCTACAACATCTACCCCCATGGCATCACTGATGTGAGGCCCCTGTACAGCAGGAGGCTGCCCAAGGG<br>GGTGAAGCACCTGAAGGACTTCCCCATCCTGCCTGGGGAGATCTTCAAGTACAAGTGGACTGTGACTGTGGAGGATGGCCCCACCAAGTCTGACCCCA<br>GGTGCCTGACCAGATACTACAGCAGCTTTGTGAACATGGAGAGGGACCTGGCCTCTGGCCTGATTGGCCCCCTGCTGATCTGCTACAAGGAGTCTGTG |

TABLE 9-continued

| ceDNA Vector Name | Nucleic Acid Sequence |
|---|---|
| | GACCAGAGGGGCAACCAGATCATGTCTGACAAGAGGAATGTGATCCTGTTCTCTGTGTTTGATGAGAACAGGAGCTGGTACCTGACTGAGAACATCCA |
| | GAGGTTCCTGCCCAACCCTGCTGGGGTGCAGCTGGAGGACCCTGAGTTCCAGGCCAGCAACATCATGCACAGCATCAATGGCTATGTGTTTGACAGCC |
| | TGCAGCTGTCTGTGTGCCTGCATGAGGTGGCCTACTGGTACATCCTGAGCATTGGGGCCCAGACTGACTTCCTGTCTGTGTTCTTCTCTGGCTACACC |
| | TTCAAGCACAAGATGGTGTATGAGGACACCCTGACCCTGTTCCCCTTCTCTGGGGAGACTGTGTTCATGAGCATGGAGAACCCTGGCCTGTGGATTCT |
| | GGGCTGCCACAACTCTGACTTCAGGAACAGGGGCATGACTGCCCTGCTGAAAGTCTCCAGCTGTGACAAGAACACTGGGGACTACTATGAGGACAGCT |
| | ATGAGGACATCTCTGCCTACCTGCTGAGCAAGAACAATGCCATTGAGCCCAGGAGCTTCAGCCAGAATGCCACTAATGTGTCTAACAACAGCAACACC |
| | AGCAATGACAGCAATGTGTCTCCCCCAGTGCTGAAGAGGCACCAGAGGGAGATCACCAGGACCACCCTGCAGTCTGACCAGGAGGAGATTGACTATGA |
| | TGACACCATCTCTGTGGAGATGAAGAAGGAGGACTTTGACATCTACGACGAGGACGAGAACCAGAGCCCCAGGAGCTTCCAGAAGAAGACCAGGCACT |
| | ACTTCATTGCTGCTGTGGAGAGGCTGTGGGACTATGGCATGAGCAGCAGCCCCCATGTGCTGAGGAACAGGGCCCAGTCTGGCTCTGTGCCCCAGTTC |
| | AAGAAGGTGGTGTTCCAGGAGTTCACTGATGGCAGCTTCACCCAGCCCCTGTACAGAGGGGAGCTGAATGAGCACCTGGGCCTGCTGGGCCCCTACAT |
| | CAGGGCTGAGGTGGAGGACAACATCATGGTGACCTTCAGGAACCAGGCCAGCAGGCCCTACAGCTTCTACAGCAGCCTGATCAGCTATGAGGAGGACC |
| | AGAGGCAGGGGGCTGAGCCCAGGAAGAACTTTGTGAAGCCCAATGAAACCAAGACCTACTTCTGGAAGGTGCAGCACCACATGGCCCCCACCAAGGAT |
| | GAGTTTGACTGCAAGGCCTGGGCCTACTTCTCTGATGTGGACCTGGAGAAGGATGTGCACTCTGGCCTGATTGGCCCCCTGCTGGTGTGCCACACCAA |
| | CACCCTGAACCCTGCCCATGGCAGGCAGGTGACTGTGCAGGAGTTTGCCCTGTTCTTCACCATCTTTGATGAAACCAAGAGCTGGTACTTCACTGAGA |
| | ACATGGAGAGGAACTGCAGGGCCCCCTGCAACATCCAGATGGAGGACCCCACCTTCAAGGAGAACTACAGGTTCCATGCCATCAATGGCTACATCATG |
| | GACACCCTGCCTGGCCTGGTGATGGCCCAGGACCAGAGGATCAGGTGGTACCTGCTGAGCATGGGCAGCAATGAGAACATCCACAGCATCCACTTCTC |
| | TGGCCATGTGTTCACTGTGAGGAAGAAGGAGGAGTACAAGATGGCCCTGTACAACCTGTACCCTGGGGTGTTTGAGACTGTGGAGATGCTGCCCAGCA |
| | AGGCTGGCATCTGGAGGGTGGAGTGCCTGATTGGGGAGCACCTGCATGCTGGCATGAGCACCCTGTTCCTGGTGTACAGCAACAAGTGCCAGACCCCC |
| | CTGGGCATGGCCTCTGGCCACATCAGGGACTTCCAGATCACTGCCTCTGGCCAGTATGGCCAGTGGGCCCCCAAGCTGGCCAGGCTGCACTACTCTGG |
| | CAGCATCAATGCCTGGAGCACCAAGGAGCCCTTCAGCTGGATCAAGGTGGACCTGCTGGCCCCCATGATCATCCATGGCATCAAGACCCAGGGGGCCA |
| | GGCAGAAGTTCAGCAGCCTGTACATCAGCCAGTTCATCATCATGTACAGCCTGGATGGCAAGAAGTGGCAGACCTACAGGGGCAACAGCACTGGCACC |
| | CTGATGGTGTTCTTTGGCAATGTGGACAGCTCTGGCATCAAGCACAACATCTTCAACCCCCCCATCATTGCCAGATACATCAGGCTGCACCCCACCCA |
| | CTACAGCATCAGGAGCACCCTGAGGATGGAGCTGATGGGCTGTGACCTGAACAGCTGCAGCATGCCCCTGGGCATGGAGAGCAAGGCCATCTCTGATG |
| | CCCAGATCACTGCCAGCAGCTACTTCACCAACATGTTTGCCACCTGGAGCCCCAGCAAGGCCAGGCTGCACCTGCAGGGCAGGAGCAATGCCTGGAGG |
| | CCCCAGGTCAACAACCCCAAGGAGTGGCTGCAGGTGGACTTCCAGAAGACCATGAAGGTGACTGGGGTGACCACCCAGGGGGTGAAGAGCCTGCTGAC |
| | CAGCATGTATGTGAAGGAGTTCCTGATCAGCAGCAGCCAGGATGGCCACCAGTGGACCCTGTTCTTCCAGAATGGCAAGGTGAAGGTGTTCCAGGGCA |
| | ACCAGGACAGCTTCACCCCTGTGGTGAACAGCCTGGACCCCCCCCTGCTGACCAGATACCTGAGGATTCACCCCCAGAGCTGGGTGCACCAGATTGCC |
| | CTGAGGATGGAGGTGCTGGGCTGTGAGGCCCAGGACCTGTACTGATTAATTAAGAGCATCTTACCGCCATTTATTCCCATATTTGTTCTGTTTTTCTT |
| | GATTTGGGTATACATTTAAATGTTAATAAAACAAAATGGTGGGGCAATCATTTACATTTTTAGGGATATGTAATTACTAGTTCAGGTGTATTGCCACA |
| | AGACAAACATGTTAAGAAACTTTCCCGTTATTTACGCTCTGTTCCTGTTAATCAACCTCTGGATTACAAAATTTGTGAAAGATTGACTGATATTCTTA |
| | ACTATGTTGCTCCTTTTACGCTGTGTGGATATGCTGCTTTATAGCCTCTGTATCTAGCTATTGCTTCCCGTACGGCTTTCGTTTTCTCCTCCTTGTAT |
| | AAATCCTGGTTGCTGTCTCTTTTAGAGGAGTTGTGGCCCGTTGTCCGTCAACGTGGCGTGGTGTGCTCTGTGTTTGCTGACGCAACCCCCACTGGCTG |
| | GGGCATTGCCACCACCTGTCAACTCCTTTCTGGGACTTTCGCTTTCCCCCTCCCGATCGCCACGGCAGAACTCATCGCCGCCTGCCTTGCCCGCTGCT |
| | GGACAGGGGCTAGGTTGCTGGGCACTGATAATTCCGTGGTGTTGTCTGTGCCTTCTAGTTGCCAGCCATCTGTTGTTTGCCCCTCCCCCGTGCCTTCC |
| | TTGACCCTGGAAGGTGCCACTCCCACTGTCCTTTCCTAATAAAATGAGGAAATTGCATCGCATTGTCTGAGTAGGTGTCATTCTATTCTGGGGGGTGG |
| | GGTGGGGCAGGACAGCAAGGGGGAGGATTGGGAAGACAATAGCAGGCATGCTGGGGATGCGGTGGGCTCTATGGCTCTAGAGCATGGCTACGTAGATA |
| | AGTAGCATGGCGGGTTAATCATTAACTACACCTGCAGGAGGAACCCCTAGTGATGGAGTTGGCCACTCCCTCTCTGCGCGCTCGCTCGCTCACTGAGG |
| | CCGGGCGACCAAAGGTCGCCCGACGCCCGGGCGGCCTCAGTGAGCGAGCGAGCGCGCAGCTGCCTGCAGGGGCGCGCCTCGAGGCATGCGGTACCAAG |
| | CTTGTCGAGAAGTACTAGAGGATCATAATCAGCCATACCACATTTGTAGAGGTTTTACTTGCTTTAAAAAACCTCCCACACCTCCCCCTGAACCTGAA |
| | ACATAAAATGAATGCAATTGTTGTTGTTAACTTGTTTATTGCAGCTTATAATGGTTACAAATAAAGCAATAGCATCACAAATTTCACAAATAAAGCAT |
| | TTTTTTCACTGCATTCTAGTTGTGGTTTGTCCAAACTCATCAATGTATCTTATCATGTCTGGATCTGATCACTGATATCGCCTAGGAGATCCGAACCA |
| | GATAAGTGAAATCTAGTTCCAAACTATTTTGTCATTTTTAATTTTCGTATTAGCTTACGACGCTACACCCAGTTCCCATCTATTTTGTCACTCTTCCC |
| | TAAATAATCCTTAAAAACTCCATTTCCACCCCTCCCAGTTCCCAACTATTTTGTCCGCCCACAGCGGGGCATTTTTCTTCCTGTTATGTTTTTAATCA |
| | AACATCCTGCCAACTCCATGTGACAAACCGTCATCTTCGGCTACTTTTTCTCTGTCACAGAATGAAAATTTTTCTGTCATCTCTTCGTTATTAATGTT |
| | TGTAATTGACTGAATATCAACGCTTATTTGCAGCCTGAATGGCGAATGGACGCGCCCTGTAGCGGCGCATTAAGCGCGGCGGGTGTGGTGGTTACGC |
| | GCAGCGTGACCGCTACACTTGCCAGCGCCCTAGCGCCCGCTCCTTTCGCTTTCTTCCCTTCCTTTCTCGCCACGTTCGCCGGCTTTCCCCGTCAAGCT |
| | CTAAATCGGGGGCTCCCTTTAGGGTTCCGATTTAGTGCTTTACGGCACCTCGACCCCAAAAAACTTGATTAGGGTGATGGTTCACGTAGTGGGCCATC |
| | GCCCTGATAGACGGTTTTTCGCCCTTTGACGTTGGAGTCCACGTTCTTTAATAGTGGACTCTTGTTCCAAACTGGAACAACACTCAACCCTATCTCGG |
| | TCTATTCTTTTGATTTATAAGGGATTTTGCCGATTTCGGCCTATTGGTTAAAAAATGAGCTGATTTAACAAAAATTTAACGCGAATTTTAACAAAATA |
| | TTAACGTTTACAATTTCAGGTGGCACTTTTCGGGGAAATGTGCGCGGAACCCCTATTTGTTTATTTTTCTAAATACATTCAAATATGTATCCGCTCAT |

TABLE 9-continued

| ceDNA Vector Name | Nucleic Acid Sequence |
|---|---|
| | GAGACAATAACCCTGATAAATGCTTCAATAATATTGAAAAAGGAAGAGTATGAGTATTCAACATTTCCGTGTCGCCCTTATTCCCTTTTTTGCGGCAT<br>TTTGCCTTCCTGTTTTTGCTCACCCAGAAACGCTGGTGAAAGTAAAAGATGCTGAAGATCAGTTGGGTGCACGAGTGGGTTACATCGAACTGGATCTC<br>AACAGCGGTAAGATCCTTGAGAGTTTTCGCCCCGAAGAACGTTTTCCAATGATGAGCACTTTTAAAGTTCTGCTATGTGGCGCGGTATTATCCCGTAT<br>TGACGCCGGGCAAGAGCAACTCGGTCGCCGCATACACTATTCTCAGAATGACTTGGTTGAGTACTCACCAGTCACAGAAAAGCATCTTACGGATGGCA<br>TGACAGTAAGAGAATTATGCAGTGCTGCCATAACCATGAGTGATAACACTGCGGCCAACTTACTTCTGACAACGATCGGAGGACCGAAGGAGCTAACC<br>GCTTTTTTGCACAACATGGGGGATCATGTAACTCGCCTTGATCGTTGGGAACCGGAGCTGAATGAAGCCATACCAAACGACGAGCGTGACACCACGAT<br>GCCTGTAGCAATGGCAACAACGTTGCGCAAACTATTAACTGGCGAACTACTTACTCTAGCTTCCCGGCAACAATTAATAGACTGGATGGAGGCGGATA<br>AAGTTGCAGGACCACTTCTGCGCTCGGCCCTTCCGGCTGGCTGGTTTATTGCTGATAAATCTGGAGCCGGTGAGCGTGGGTCTCGCGGTATCATTGCA<br>GCACTGGGGCCAGATGGTAAGCCCTCCCGTATCGTAGTTATCTACACGACGGGGAGTCAGGCAACTATGGATGAACGAAATAGACAGATCGCTGAGAT<br>AGGTGCCTCACTGATTAAGCATTGGTAACTGTCAGACCAAGTTTACTCATATATACTTTAGATTGATTTAAAACTTCATTTTTAATTTAAAAGGATCT<br>AGGTGAAGATCCTTTTTGATAATCTCATGACCAAAATCCCTTAACGTGAGTTTTCGTTCCACTGAGCGTCAGACCCCGTAGAAAAGATCAAAGGATCT<br>TCTTGAGATCCTTTTTTTCTGCGCGTAATCTGCTGCTTGCAAACAAAAAAACCACCGCTACCAGCGGTGGTTTGTTTGCCGGATCAAGAGCTACCAAC<br>TCTTTTTCCGAAGGTAACTGGCTTCAGCAGAGCGCAGATACCAAATACTGTCCTTCTAGTGTAGCCGTAGTTAGGCCACCACTTCAAGAACTCTGTAG<br>CACCGCCTACATACCTCGCTCTGCTAATCCTGTTACCAGTGGCTGCTGCCAGTGGCGATAAGTCGTGTCTTACCGGGTTGGACTCAAGACGATAGTTA<br>CCGGATAAGGCGCAGCGGTCGGGCTGAACGGGGGGTTCGTGCACACAGCCCAGCTTGGAGCGAACGACCTACACCGAACTGAGATACCTACAGCGTGA<br>GCATTGAGAAAGCGCCACGCTTCCCGAAGGGAGAAAGGCGGACAGGTATCCGGTAAGCGGCAGGGTCGGAACAGGAGAGCGCACGAGGGAGCTTCCAG<br>GGGGAAACGCCTGGTATCTTTATAGTCCTGTCGGGTTTCGCCACCTCTGACTTGAGCGTCGATTTTTGTGATGCTCGTCAGGGGGGCGGAGCCTATGG<br>AAAAACGCCAGCAACGCGGCCTTTTTACGGTTCCTGGCCTTTTGCTGGCCTTTTGCTCACATGTTCTTTCCTGCGTTATCCCCTGATTCTGTGGATAA<br>CCGTATTACCGCCTTTGAGTGAGCTGATACCGCTCGCCGCAGCCGAACGACCGAGCGCAGCGAGTCAGTGAGCGAGGAAGCGGAAGAGCGCCTGATGC<br>GGTATTTTCTCCTTACGCATCTGTGCGGTATTTCACACCGCAGACCAGCCGCGTAACCTGGCAAAATCGGTTACGGTTGAGTAATAAATGGATGCCCT<br>GCGTAAGCGGGTGTGGGCGGACAATAAAGTCTTAAACTGAACAAAATAGATCTAAACTATGACAATAAAGTCTTAAACTAGACAGAATAGTTGTAAAC<br>TGAAATCAGTCCAGTTATGCTGTGAAAAAGCATACTGGACTTTTGTTATGGCTAAAGCAAACTCTTCATTTTCTGAAGTGCAAATTGCCCGTCGTATT<br>AAAGAGGGGCGTGGCCAAGGGCATGGTAAAGACTATATTCGCGGCGTTGTGACAATTTACCGAACAACTCCGCGGCCGGGAAGCCGATCTCGGCTTGA<br>ACGAATTGTTAGGTGGCGGTACTTGGGTCGATATCAAAGTGCATCACTTCTTCCCGTATGCCCAACTTTGTATAGAGAGCCACTGCGGGATCGTCACC<br>GTAATCTGCTTGCACGTAGATCACATAAGCACCAAGCGCGTTGGCCTCATGCTTGAGGAGATTGATGAGCGCGGTGGCAATGCCCTGCCTCCGGTGCT<br>CGCCGGAGACTGCGAGATCATAGATATAGATCTCACTACGCGGCTGCTCAAACCTGGGCAGAACGTAAGCCGCGAGAGCGCCAACAACCGCTTCTTGG<br>TCGAAGGCAGCAAGCGCGATGAATGTCTTACTACGGAGCAAGTTCCCGAGGTAATCGGAGTCCGGCTGATGTTGGGAGTAGGTGGCTACGTCTCCGAA<br>CTCACGACCGAAAAGATCAAGAGCAGCCCGCATGGATTTGACTTGGTCAGGGCCGAGCCTACATGTGCGAATGATGCCCATACTTGAGCCACCTAACT<br>TTGTTTTAGGGCGACTGCCCTGCTGCGTAACATCGTTGCTGCTGCGTAACATCGTTGCTGCTCCATAACATCAAACATCGACCCACGGCGTAACGCGC<br>TTGCTGCTTGGATGCCCGAGGCATAGACTGTACAAAAAAACAGTCATAACAAGCCATGAAAACCGCCACTGCGCCGTTACCACCGCTGCGTTCGGTCA<br>AGGTTCTGGACCAGTTGCGTGAGCGCATACGCTACTTGCATTACAGTTTACGAACCGAACAGGCTTATGTCAACTGGGTTCGTGCCTTCATCCGTTTC<br>CACGGTGTGCGTCACCCGGCAACCTTGGGCAGCAGCGAAGTCGAGGCATTTCTGTCCTGGCTGGCGAACGAGCGCAAGGTTTCGGTCTCCACGCATCG<br>TCAGGCATTGGCGGCCTTGCTGTTCTTCTACGGCAAGGTGCTGTGCACGGATCTGCCCTGGCTTCAGGAGATCGGAAGACCTCGGCCGTCGCGGCGCT<br>TGCCGGTGGTGCTGACCCCGGATGAAGTGGTTCGCATCCTCGGTTTTCTGGAAGGCGAGCATCGTTTGTTCGCCCAGGACTCTAGCTATAGTTCTAGT<br>GGTTGGCTACGTATACTCCGGAATATTAATAGATCATGGAGATAATTAAAATGATAACCATCTCGCAAATAAATAAGTATTTTACTGTTTTCGTAACA<br>GTTTTGTAATAAAAAAACCTATAAATATTCCGGATTATTCATACCGTCCCACCATCGGGCGCGGATCTCGGTCCGAAACCATGTCGTACTACCATCAC<br>CATCACCATCACGATTACGATATCCCAACGACCGAAAACCTGTATTTTCAGGGCGCCATGGGATCC |
| ceDNAFVIII-vector 20 (SEQ ID NO: 211) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGA**CGGGGGAGGCTGCTGGTGAATATTAACCAAGGTCACCCCAGTTATCGGAGGAGCAAACAGGGGCTAAGTCCACACGCGTGGTACCGTCTGTC**<br>**TGCACATTTCGTAGAGCGAGTGTTCCGATACTCTAATCTCCCTAGGCAAGGTTCATATTTGTGTAGGTTACTTATTCTCCTTTTGTTGACTAAGTCAA**<br>**TAATCAGAATCAGCAGGTTTGGAGTCAGCTTGGCAGGGATCAGCAGCCTGGGTTGGAAGGAGGGG**GTATAAAAGCCCCTTCACCAGGAGAAGCCGTCA<br>CACAGATCCACAAGCTCCTGAAGAGGTAAGGGTTTAAGGGATGGTTGGTTGGTGGGGTATTAATGTTTAATTACCTGGAGCACCTGCCTGAAATCACT<br>TTTTTTCAGGTTGGTTTAAACGCCGCCACCATGCAGATTGAGCTGAGCACCTGCTTCTTCCTGTGCCTGCTGAGGTTCTGCTTCTCTGCCACCAGGAG<br>ATACTACCTGGGGGCTGTGGAGCTGAGCTGGGACTACATGCAGTCTGACCTGGGGGAGCTGCCTGTGGATGCCAGGTTCCCCCCCAGAGTGCCCAAGA<br>GCTTCCCCTTCAACACCTCTGTGGTGTACAAGAAGACCCTGTTTGTGGAGTTCACTGACCACCTGTTCAACATTGCCAAGCCCAGGCCCCCCTGGATG<br>GGCCTGCTGGGCCCCACCATCCAGGCTGAGGTGTATGACACTGTGGTGATCACCCTGAAGAACATGGCCAGCCACCCTGTGAGCCTGCATGCTGTGGG<br>GGTGAGCTACTGGAAGGCCTCTGAGGGGGCTGAGTATGATGACCAGACCAGCCAGAGGGAGAAGGAGGATGACAAGGTGTTCCCTGGGGGCAGCCACA<br>CCTATGTGTGGCAGGTGCTGAAGGAGAATGGCCCCATGGCCTCTGACCCCCTGTGCCTGACCTACAGCTACCTGAGCCATGTGGACCTGGTGAAGGAC |

TABLE 9-continued

| ceDNA Vector Name | Nucleic Acid Sequence |
|---|---|
| | CTGAACTCTGGCCTGATTGGGGCCCTGCTGGTGTGCAGGGAGGGCAGCCTGGCCAAGGAGAAGACCCAGACCCTGCACAAGTTCATCCTGCTGTTTGC |
| | TGTGTTTGATGAGGGCAAGAGCTGGCACTCTGAAACCAAGAACAGCCTGATGCAGGACAGGGATGCTGCCTCTGCCAGGGCCTGGCCCAAGATGCACA |
| | CTGTGAATGGCTATGTGAACAGGAGCCTGCCTGGCCTGATTGGCTGCCACAGGAAGTCTGTGTACTGGCATGTGATTGGCATGGGCACCACCCCTGAG |
| | GTGCACAGCATCTTCCTGGAGGGCCACACCTTCCTGGTCAGGAACCACAGGCAGGCCAGCCTGGAGATCAGCCCCATCACCTTCCTGACTGCCCAGAC |
| | CCTGCTGATGGACCTGGGCCAGTTCCTGCTGTTCTGCCACATCAGCAGCCACCAGCATGATGGCATGGAGGCCTATGTGAAGGTGGACAGCTGCCCTG |
| | AGGAGCCCCAGCTGAGGATGAAGAACAATGAGGAGGCTGAGGACTATGATGATGACCTGACTGACTCTGAGATGGATGTGGTGAGGTTTGATGATGAC |
| | AACAGCCCCAGCTTCATCCAGATCAGGTCTGTGGCCAAGAAGCACCCCAAGACCTGGGTGCACTACATTGCTGCTGAGGAGGAGGACTGGGACTATGC |
| | CCCCCTGGTGCTGGCCCCTGATGACAGGAGCTACAAGAGCCAGTACCTGAACAATGGCCCCCAGAGGATTGGCAGGAAGTACAAGAAGGTCAGGTTCA |
| | TGGCCTACACTGATGAAACCTTCAAGACCAGGGAGGCCATCCAGCATGAGTCTGGCATCCTGGGCCCCCTGCTGTATGGGGAGGTGGGGGACACCCTG |
| | CTGATCATCTTCAAGAACCAGGCCAGCAGGCCCTACAACATCTACCCCCATGGCATCACTGATGTGAGGCCCCTGTACAGCAGGAGGCTGCCCAAGGG |
| | GGTGAAGCACCTGAAGGACTTCCCCATCCTGCCTGGGGAGATCTTCAAGTACAAGTGGACTGTGACTGTGGAGGATGGCCCCACCAAGTCTGACCCCA |
| | GGTGCCTGACCAGATACTACAGCAGCTTTGTGAACATGGAGAGGGACCTGGCCTCTGGCCTGATTGGCCCCCTGCTGATCTGCTACAAGGAGTCTGTG |
| | GACCAGAGGGGCAACCAGATCATGTCTGACAAGAGGAATGTGATCCTGTTCTCTGTGTTTGATGAGAACAGGAGCTGGTACCTGACTGAGAACATCCA |
| | GAGGTTCCTGCCCAACCCTGCTGGGGTGCAGCTGGAGGACCCTGAGTTCCAGGCCAGCAACATCATGCACAGCATCAATGGCTATGTGTTTGACAGCC |
| | TGCAGCTGTCTGTGTGCCTGCATGAGGTGGCCTACTGGTACATCCTGAGCATTGGGGCCCAGACTGACTTCCTGTCTGTGTTCTTCTCTGGCTACACC |
| | TTCAAGCACAAGATGGTGTATGAGGACACCCTGACCCTGTTCCCCTTCTCTGGGGAGACTGTGTTCATGAGCATGGAGAACCCTGGCCTGTGGATTCT |
| | GGGCTGCCACAACTCTGACTTCAGGAACAGGGGCATGACTGCCCTGCTGAAAGTCTCCAGCTGTGACAAGAACACTGGGGACTACTATGAGGACAGCT |
| | ATGAGGACATCTCTGCCTACCTGCTGAGCAAGAACAATGCCATTGAGCCCAGGAGCTTCAGCCAGAATGCCACTAATGTGTCTAACAACAGCAACACC |
| | AGCAATGACAGCAATGTGTCTCCCCCAGTGCTGAAGAGGCACCAGAGGGAGATCACCAGGACCACCCTGCAGTCTGACCAGGAGGAGATTGACTATGA |
| | TGACACCATCTCTGTGGAGATGAAGAAGGAGGACTTTGACATCTACGACGAGGACGAGAACCAGAGCCCCAGGAGCTTCCAGAAGAAGACCAGGCACT |
| | ACTTCATTGCTGCTGTGGAGAGGCTGTGGGACTATGGCATGAGCAGCAGCCCCCATGTGCTGAGGAACAGGGCCCAGTCTGGCTCTGTGCCCCAGTTC |
| | AAGAAGGTGGTGTTCCAGGAGTTCACTGATGGCAGCTTCACCCAGCCCCTGTACAGAGGGGAGCTGAATGAGCACCTGGGCCTGCTGGGCCCCTACAT |
| | CAGGGCTGAGGTGGAGGACAACATCATGGTGACCTTCAGGAACCAGGCCAGCAGGCCCTACAGCTTCTACAGCAGCCTGATCAGCTATGAGGAGGACC |
| | AGAGGCAGGGGGCTGAGCCCAGGAAGAACTTTGTGAAGCCCAATGAAACCAAGACCTACTTCTGGAAGGTGCAGCACCACATGGCCCCCACCAAGGAT |
| | GAGTTTGACTGCAAGGCCTGGGCCTACTTCTCTGATGTGGACCTGGAGAAGGATGTGCACTCTGGCCTGATTGGCCCCCTGCTGGTGTGCCACACCAA |
| | CACCCTGAACCCTGCCCATGGCAGGCAGGTGACTGTGCAGGAGTTTGCCCTGTTCTTCACCATCTTTGATGAAACCAAGAGCTGGTACTTCACTGAGA |
| | ACATGGAGAGGAACTGCAGGGCCCCCTGCAACATCCAGATGGAGGACCCCACCTTCAAGGAGAACTACAGGTTCCATGCCATCAATGGCTACATCATG |
| | GACACCCTGCCTGGCCTGGTGATGGCCCAGGACCAGAGGATCAGGTGGTACCTGCTGAGCATGGGCAGCAATGAGAACATCCACAGCATCCACTTCTC |
| | TGGCCATGTGTTCACTGTGAGGAAGAAGGAGGAGTACAAGATGGCCCTGTACAACCTGTACCCTGGGGTGTTTGAGACTGTGGAGATGCTGCCCAGCA |
| | AGGCTGGCATCTGGAGGGTGGAGTGCCTGATTGGGGAGCACCTGCATGCTGGCATGAGCACCCTGTTCCTGGTGTACAGCAACAAGTGCCAGACCCCC |
| | CTGGGCATGGCCTCTGGCCACATCAGGGACTTCCAGATCACTGCCTCTGGCCAGTATGGCCAGTGGGCCCCCAAGCTGGCCAGGCTGCACTACTCTGG |
| | CAGCATCAATGCCTGGAGCACCAAGGAGCCCTTCAGCTGGATCAAGGTGGACCTGCTGGCCCCCATGATCATCCATGGCATCAAGACCCAGGGGGCCA |
| | GGCAGAAGTTCAGCAGCCTGTACATCAGCCAGTTCATCATCATGTACAGCCTGGATGGCAAGAAGTGGCAGACCTACAGGGGCAACAGCACTGGCACC |
| | CTGATGGTGTTCTTTGGCAATGTGGACAGCTCTGGCATCAAGCACAACATCTTCAACCCCCCCATCATTGCCAGATACATCAGGCTGCACCCCACCCA |
| | CTACAGCATCAGGAGCACCCTGAGGATGGAGCTGATGGGCTGTGACCTGAACAGCTGCAGCATGCCCCTGGGCATGGAGAGCAAGGCCATCTCTGATG |
| | CCCAGATCACTGCCAGCAGCTACTTCACCAACATGTTTGCCACCTGGAGCCCCAGCAAGGCCAGGCTGCACCTGCAGGGCAGGAGCAATGCCTGGAGG |
| | CCCCAGGTCAACAACCCCAAGGAGTGGCTGCAGGTGGACTTCCAGAAGACCATGAAGGTGACTGGGGTGACCACCCAGGGGGTGAAGAGCCTGCTGAC |
| | CAGCATGTATGTGAAGGAGTTCCTGATCAGCAGCAGCCAGGATGGCCACCAGTGGACCCTGTTCTTCCAGAATGGCAAGGTGAAGGTGTTCCAGGGCA |
| | ACCAGGACAGCTTCACCCCTGTGGTGAACAGCCTGGACCCCCCCCTGCTGACCAGATACCTGAGGATTCACCCCCAGAGCTGGGTGCACCAGATTGCC |
| | CTGAGGATGGAGGTGCTGGGCTGTGAGGCCCAGGACCTGTACTGATTAATTAAGAGCATCTTACCGCCATTTATTCCCATATTTGTTCTGTTTTTCTT |
| | GATTTGGGTATACATTTAAATGTTAATAAAACAAAATGGTGGGGCAATCATTTACATTTTTAGGGATATGTAATTACTAGTTCAGGTGTATTGCCACA |
| | AGACAAACATGTTAAGAAACTTTCCCGTTATTTACGCTCTGTTCCTGTTAATCAACCTCTGGATTACAAAATTTGTGAAAGATTGACTGATATTCTTA |
| | ACTATGTTGCTCCTTTTACGCTGTGTGGATATGCTGCTTTATAGCCTCTGTATCTAGCTATTGCTTCCCGTACGGCTTTCGTTTTCTCCTCCTTGTAT |
| | AAATCCTGGTTGCTGTCTCTTTTAGAGGAGTTGTGGCCCGTTGTCCGTCAACGTGGCGTGGTGTGCTCTGTGTTTGCTGACGCAACCCCCACTGGCTG |
| | GGGCATTGCCACCACCTGTCAACTCCTTTCTGGGACTTTCGCTTTCCCCCTCCCGATCGCCACGGCAGAACTCATCGCCGCCTGCCTTGCCCGCTGCT |
| | GGACAGGGGCTAGGTTGCTGGGCACTGATAATTCCGTGGTGTTGTCTCCATAAAGTAGGAAACACTACACGATTCCATAAAGTAGGAAACACTACATC |
| | ACTCCATAAAGTAGGAAACACTACATGTGCCTTCTAGTTGCCAGCCATCTGTTGTTTGCCCCTCCCCCGTGCCTTCCTTGACCCTGGAAGGTGCCACT |
| | CCCACTGTCCTTTCCTAATAAAATGAGGAAATTGCATCGCATTGTCTGAGTAGGTGTCATTCTATTCTGGGGGGTGGGGTGGGGCAGGACAGCAAGGG |
| | GGAGGATTGGGAAGACAATAGCAGGCATGCTGGGGATGCGGTGGGCTCTATGGCTCTAGAGCATGGCTACGTAGATAAGTAGCATGGCGGGTTAATCA |
| | TTAACTACACCTGCAGGAGGAACCCCTAGTGATGGAGTTGGCCACTCCCTCTCTGCGCGCTCGCTCGCTCACTGAGGCCGGGCGACCAAAGGTCGCCC |

TABLE 9-continued

| ceDNA Vector Name | Nucleic Acid Sequence |
|---|---|
| | GACGCCCGGGCGGCCTCAGTGAGCGAGCGAGCGCGCAGCTGCCTGCAGGGGCGCGCCTCGAGGCATGCGGTACCAAGCTTGTCGAGAAGTACTAGAGG<br>ATCATAATCAGCCATACCACATTTGTAGAGGTTTTACTTGCTTTAAAAAACCTCCCACACCTCCCCCTGAACCTGAAACATAAAATGAATGCAATTGT<br>TGTTGTTAACTTGTTTATTGCAGCTTATAATGGTTACAAATAAAGCAATAGCATCACAAATTTCACAAATAAAGCATTTTTTTCACTGCATTCTAGTT<br>GTGGTTTGTCCAAACTCATCAATGTATCTTATCATGTCTGGATCTGATCACTGATATCGCCTAGGAGATCCGAACCAGATAAGTGAAATCTAGTTCCA<br>AACTATTTTGTCATTTTTAATTTTCGTATTAGCTTACGACGCTACACCCAGTTCCCATCTATTTTGTCACTCTTCCCTAAATAATCCTTAAAAACTCC<br>ATTTCCACCCCTCCCAGTTCCCAACTATTTTGTCCGCCCACAGCGGGGCATTTTTCTTCCTGTTATGTTTTTAATCAAACATCCTGCCAACTCCATGT<br>GACAAACCGTCATCTTCGGCTACTTTTTCTCTGTCACAGAATGAAAATTTTTCTGTCATCTCTTCGTTATTAATGTTTGTAATTGACTGAATATCAAC<br>GCTTATTTGCAGCCTGAATGGCGAATGGACGCGCCCTGTAGCGGCGCATTAAGCGCGGCGGGTGTGGTGGTTACGCGCAGCGTGACCGCTACACTTG<br>CCAGCGCCCTAGCGCCCGCTCCTTTCGCTTTCTTCCCTTCCTTTCTCGCCACGTTCGCCGGCTTTCCCCGTCAAGCTCTAAATCGGGGGCTCCCTTTA<br>GGGTTCCGATTTAGTGCTTTACGGCACCTCGACCCCAAAAAACTTGATTAGGGTGATGGTTCACGTAGTGGGCCATCGCCCTGATAGACGGTTTTTCG<br>CCCTTTGACGTTGGAGTCCACGTTCTTTAATAGTGGACTCTTGTTCCAAACTGGAACAACACTCAACCCTATCTCGGTCTATTCTTTTGATTTATAAG<br>GGATTTTGCCGATTTCGGCCTATTGGTTAAAAAATGAGCTGATTTAACAAAAATTTAACGCGAATTTTAACAAAATATTAACGTTTACAATTTCAGGT<br>GGCACTTTTCGGGGAAATGTGCGCGGAACCCCTATTTGTTTATTTTTCTAAATACATTCAAATATGTATCCGCTCATGAGACAATAACCCTGATAAAT<br>GCTTCAATAATATTGAAAAAGGAAGAGTATGAGTATTCAACATTTCCGTGTCGCCCTTATTCCCTTTTTTGCGGCATTTTGCCTTCCTGTTTTTGCTC<br>ACCCAGAAACGCTGGTGAAAGTAAAAGATGCTGAAGATCAGTTGGGTGCACGAGTGGGTTACATCGAACTGGATCTCAACAGCGGTAAGATCCTTGAG<br>AGTTTTCGCCCCGAAGAACGTTTTCCAATGATGAGCACTTTTAAAGTTCTGCTATGTGGCGCGGTATTATCCCGTATTGACGCCGGGCAAGAGCAACT<br>CGGTCGCCGCATACACTATTCTCAGAATGACTTGGTTGAGTACTCACCAGTCACAGAAAAGCATCTTACGGATGGCATGACAGTAAGAGAATTATGCA<br>GTGCTGCCATAACCATGAGTGATAACACTGCGGCCAACTTACTTCTGACAACGATCGGAGGACCGAAGGAGCTAACCGCTTTTTTGCACAACATGGGG<br>GATCATGTAACTCGCCTTGATCGTTGGGAACCGGAGCTGAATGAAGCCATACCAAACGACGAGCGTGACACCACGATGCCTGTAGCAATGGCAACAAC<br>GTTGCGCAAACTATTAACTGGCGAACTACTTACTCTAGCTTCCCGGCAACAATTAATAGACTGGATGGAGGCGGATAAAGTTGCAGGACCACTTCTGC<br>GCTCGGCCCTTCCGGCTGGCTGGTTTATTGCTGATAAATCTGGAGCCGGTGAGCGTGGGTCTCGCGGTATCATTGCAGCACTGGGGCCAGATGGTAAG<br>CCCTCCCGTATCGTAGTTATCTACACGACGGGGAGTCAGGCAACTATGGATGAACGAAATAGACAGATCGCTGAGATAGGTGCCTCACTGATTAAGCA<br>TTGGTAACTGTCAGACCAAGTTTACTCATATATACTTTAGATTGATTTAAAACTTCATTTTTAATTTAAAAGGATCTAGGTGAAGATCCTTTTTGATA<br>ATCTCATGACCAAAATCCCTTAACGTGAGTTTTCGTTCCACTGAGCGTCAGACCCCGTAGAAAAGATCAAAGGATCTTCTTGAGATCCTTTTTTTCTG<br>CGCGTAATCTGCTGCTTGCAAACAAAAAAACCACCGCTACCAGCGGTGGTTTGTTTGCCGGATCAAGAGCTACCAACTCTTTTTCCGAAGGTAACTGG<br>CTTCAGCAGAGCGCAGATACCAAATACTGTCCTTCTAGTGTAGCCGTAGTTAGGCCACCACTTCAAGAACTCTGTAGCACCGCCTACATACCTCGCTC<br>TGCTAATCCTGTTACCAGTGGCTGCTGCCAGTGGCGATAAGTCGTGTCTTACCGGGTTGGACTCAAGACGATAGTTACCGGATAAGGCGCAGCGGTCG<br>GGCTGAACGGGGGGTTCGTGCACACAGCCCAGCTTGGAGCGAACGACCTACACCGAACTGAGATACCTACAGCGTGAGCATTGAGAAAGCGCCACGCT<br>TCCCGAAGGGAGAAAGGCGGACAGGTATCCGGTAAGCGGCAGGGTCGGAACAGGAGAGCGCACGAGGGAGCTTCCAGGGGGAAACGCCTGGTATCTTT<br>ATAGTCCTGTCGGGTTTCGCCACCTCTGACTTGAGCGTCGATTTTTGTGATGCTCGTCAGGGGGGCGGAGCCTATGGAAAAACGCCAGCAACGCGGCC<br>TTTTTACGGTTCCTGGCCTTTTGCTGGCCTTTTGCTCACATGTTCTTTCCTGCGTTATCCCCTGATTCTGTGGATAACCGTATTACCGCCTTTGAGTG<br>AGCTGATACCGCTCGCCGCAGCCGAACGACCGAGCGCAGCGAGTCAGTGAGCGAGGAAGCGGAAGAGCGCCTGATGCGGTATTTTCTCCTTACGCATC<br>TGTGCGGTATTTCACACCGCAGACCAGCCGCGTAACCTGGCAAAATCGGTTACGGTTGAGTAATAAATGGATGCCCTGCGTAAGCGGGTGTGGGCGGA<br>CAATAAAGTCTTAAACTGAACAAAATAGATCTAAACTATGACAATAAAGTCTTAAACTAGACAGAATAGTTGTAAACTGAAATCAGTCCAGTTATGCT<br>GTGAAAAAGCATACTGGACTTTTGTTATGGCTAAAGCAAACTCTTCATTTTCTGAAGTGCAAATTGCCCGTCGTATTAAAGAGGGGCGTGGCCAAGGG<br>CATGGTAAAGACTATATTCGCGGCGTTGTGACAATTTACCGAACAACTCCGCGGCCGGGAAGCCGATCTCGGCTTGAACGAATTGTTAGGTGGCGGTA<br>CTTGGGTCGATATCAAAGTGCATCACTTCTTCCCGTATGCCCAACTTTGTATAGAGAGCCACTGCGGGATCGTCACCGTAATCTGCTTGCACGTAGAT<br>CACATAAGCACCAAGCGCGTTGGCCTCATGCTTGAGGAGATTGATGAGCGCGGTGGCAATGCCCTGCCTCCGGTGCTCGCCGGAGACTGCGAGATCAT<br>AGATATAGATCTCACTACGCGGCTGCTCAAACCTGGGCAGAACGTAAGCCGCGAGAGCGCCAACAACCGCTTCTTGGTCGAAGGCAGCAAGCGCGATG<br>AATGTCTTACTACGGAGCAAGTTCCCGAGGTAATCGGAGTCCGGCTGATGTTGGGAGTAGGTGGCTACGTCTCCGAACTCACGACCGAAAAGATCAAG<br>AGCAGCCCGCATGGATTTGACTTGGTCAGGGCCGAGCCTACATGTGCGAATGATGCCCATACTTGAGCCACCTAACTTTGTTTTAGGGCGACTGCCCT<br>GCTGCGTAACATCGTTGCTGCTGCGTAACATCGTTGCTGCTCCATAACATCAAACATCGACCCACGGCGTAACGCGCTTGCTGCTTGGATGCCCGAGG<br>CATAGACTGTACAAAAAAACAGTCATAACAAGCCATGAAAACCGCCACTGCGCCGTTACCACCGCTGCGTTCGGTCAAGGTTCTGGACCAGTTGCGTG<br>AGCGCATACGCTACTTGCATTACAGTTTACGAACCGAACAGGCTTATGTCAACTGGGTTCGTGCCTTCATCCGTTTCCACGGTGTGCGTCACCCGGCA<br>ACCTTGGGCAGCAGCGAAGTCGAGGCATTTCTGTCCTGGCTGGCGAACGAGCGCAAGGTTTCGGTCTCCACGCATCGTCAGGCATTGGCGGCCTTGCT<br>GTTCTTCTACGGCAAGGTGCTGTGCACGGATCTGCCCTGGCTTCAGGAGATCGGAAGACCTCGGCCGTCGCGGCGCTTGCCGGTGGTGCTGACCCCGG<br>ATGAAGTGGTTCGCATCCTCGGTTTTCTGGAAGGCGAGCATCGTTTGTTCGCCCAGGACTCTAGCTATAGTTCTAGTGGTTGGCTACGTATACTCCGG<br>AATATTAATAGATCATGGAGATAATTAAAATGATAACCATCTCGCAAATAAATAAGTATTTTACTGTTTTCGTAACAGTTTTGTAATAAAAAAACCTA<br>TAAATATTCCGGATTATTCATACCGTCCCACCATCGGGCGCGGATCTCGGTCCGAAACCATGTCGTACTACCATCACCATCACCATCACGATTACGAT<br>ATCCCAACGACCGAAAACCTGTATTTTCAGGGCGCCATGGGATCC |

TABLE 9-continued

| ceDNA Vector Name | Nucleic Acid Sequence |
|---|---|
| ceDNAFVIII-<br>vector 21<br>(SEQ ID NO:<br>212) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGAGCGGCCGCTCAATATTGGCCATTAGCCATATTATTCATTGGTTATATAGCATAAATCAATATTGGCTATTGGCCATTGCATACGTTGTATCT<br>ATATCATAATATGTACATTTATATTGGCTCATGTCCAATATGACCGCCATGTTGGCATTGATTATTGACTAGTTATTAATAGTAATCAATTACGGGGT<br>CATTAGTTCATAGCCCATATATGGAGTTCCGCGTTACATAACTTACGGTAAATGGCCCGCCTGGCTGACCGCCCAACGACCCCCGCCCATTGACGTCA<br>ATAATGACGTATGTTCCCATAGTAACGCCAATAGGGACTTTCCATTGACGTCAATGGGTGGAGTATTTACGGTAAACTGCCCACTTGGCAGTACATCA<br>AGTGTATCATATGCCAAGTCCGCCCCCTATTGACGTCAATGACGGTAAATGGCCCGCCTGGCATTATGCCCAGTACATGACCTTACGGGACTTTCCTA<br>CTTGGCAGTACATCTACGTATTAGTCATCGCTATTACCATGG**TCGAGGTGAGCCCCACGTTCTGCTTCACTCTCCCCATCTCCCCCCCCTCCCCACCC**<br>**CCAATTTTGTATTTATTTATTTTTTAATTATTTTGTGCAGCGATGGGGGCGGGGGGGGGGGGGGGGCGCGCGCCAGGCGGGGCGGGGCGGGGCGAGGG**<br>**GCGGGGCGGGGCGAGGCGGAGAGGTGCGGCGGCAGCCAATCAGAGCGGCGCGCTCCGAAAGTTTCCTTTTATGGCGAGGCGGCGGCGGCGGCGGCCCT**<br>**ATA**AAAAGCGAAGCGCGCGGCGGGCGGGAGTCGCTGCGACGCTGCCTTCGCCCCGTGCCCCGCTCCGCCGCCGCCTCGCGCCGCCCGCCCCGGCTCTG<br>ACTGACCGCGTTACTCCCACAGGTGAGCGGGCGGGACGGCCCTTCTCCTCCGGGCTGTAATTAGCGCTTGGTTTAATGACGGCTTGTTTCTTTTCTGT<br>GGCTGCGTGAAAGCCTTGAGGGGCTCCGGGAGGGCCCTTTGTGCGGGGGGGAGCGGCTCGGGGGGTGCGTGCGTGTGTGTGTGCGTGGGGAGCGCCGC<br>GTGCGGCCCGCGCTGCCCGGCGGCTGTGAGCGCTGCGGGCGCGGCGCGGGGCTTTGTGCGCTCCGCAGTGTGCGCGAGGGGAGCGCGGCCGGGGGCGG<br>TGCCCCGCGGTGCGGGGGGGGCTGCGAGGGGAACAAAGGCTGCGTGCGGGGTGTGTGCGTGGGGGGGTGAGCAGGGGGTGTGGGCGCGGCGGTCGGGC<br>TGTAACCCCCCCCTGCACCCCCCTCCCCGAGTTGCTGAGCACGGCCCGGCTTCGGGTGCGGGGCTCCGTACGGGGCGTGGCGCGGGGCTCGCCGTGCC<br>GGGCGGGGGGTGGCGGCAGGTGGGGGTGCCGGGCGGGGCGGGGCCGCCTCGGGCCGGGGAGGGCTCGGGGGAGGGGCGCGGCGGCCCCCGGAGCGCCG<br>GCGGCTGTCGAGGCGCGGCGAGCCGCAGCCATTGCCTTTTATGGTAATCGTGCGAGAGGGCGCAGGGACTTCCTTTGTCCCAAATCTGTGCGGAGCCG<br>AAATCTGGGAGGCGCCGCCGCACCCCCTCTAGCGGGCGCGGGGCGAAGCGGTGCGGCGCCGGCAGGAAGGAAATGGGCGGGGAGGGCCTTCGTGCGTC<br>GCCGCGCCGCCGTCCCCTTCTCCCTCTCCAGCCTCGGGGCTGTCCGCGGGGGGACGGCTGCCTTCGGGGGGGACGGGGCAGGGCGGGGTTCGGCTTCT<br>GGCGTGTGACCGGCGGCTCTAGAGCCTCTGCTAACCATGTTTTAGCCTTCTTCTTTTTCCTACAGCTCCTGGGCAACGTGCTGGTTATTGTGCTGTCT<br>CATCATTTGTCGACAGAATTCCTCGAAGATCCGAAGGGGTTCAAGCTTGGCATTCCGGTACTGTTGGTAAAGCCAGTTTAAACGCCGCCACCATGCAG<br>ATCGAGCTGTCTACCTGCTTCTTCCTGTGCCTGCTGCGGTTCTGCTTCAGCGCCACCAGAAGATATTACCTGGGCGCCGTGGAACTGAGCTGGGACTA<br>CATGCAGTCTGACCTGGGAGAGCTGCCCGTGGACGCTAGATTTCCTCCAAGAGTGCCCAAGAGCTTCCCCTTCAACACCTCCGTGGTGTACAAGAAAA<br>CCCTGTTCGTGGAATTCACCGACCACCTGTTCAATATCGCCAAGCCTCGGCCTCCTTGGATGGGACTGCTGGGACCTACAATTCAGGCCGAGGTGTAC<br>GACACCGTGGTCATCACCCTGAAGAACATGGCCAGCCATCCTGTGTCTCTGCACGCCGTGGGAGTGTCTTATTGGAAGGCTTCTGAGGGCGCCGAGTA<br>CGACGATCAGACAAGCCAGAGAGAGAAAGAGGACGACAAGGTTTTCCCTGGCGGCAGCCACACCTATGTCTGGCAGGTCCTGAAAGAAAACGGCCCTA<br>TGGCCTCCGATCCTCTGTGCCTGACATACAGCTACCTGAGCCACGTGGACCTGGTCAAGGACCTGAATTCTGGCCTGATCGGAGCCCTGCTCGTGTGT<br>AGAGAAGGCAGCCTGGCCAAAGAGAAAACCCAGACACTGCACAAGTTCATCCTGCTGTTCGCCGTGTTCGACGAGGGCAAGAGCTGGCACAGCGAGAC<br>AAAGAACAGCCTGATGCAGGACAGGGATGCCGCCTCTGCTAGAGCTTGGCCTAAGATGCACACCGTGAACGGCTACGTGAACAGAAGCCTGCCTGGAC<br>TGATCGGCTGCCACAGAAAGTCCGTGTACTGGCACGTGATCGGCATGGGCACAACACCTGAGGTGCACAGCATCTTTCTGGAAGGCCACACCTTCCTC<br>GTGCGGAACCACAGACAGGCCAGCCTGGAAATCAGCCCTATCACCTTCCTGACCGCTCAGACCCTGCTGATGGATCTGGGCCAGTTTCTGCTGTTCTG<br>CCACATCAGCTCCCACCAGCACGATGGCATGGAAGCCTACGTGAAGGTGGACAGCTGCCCCGAAGAACCCCAGCTGCGGATGAAGAACAACGAGGAAG<br>CCGAGGACTACGACGACGACCTGACCGACTCTGAGATGGACGTCGTCAGATTCGACGACGATAACAGCCCCAGCTTCATCCAGATCAGAAGCGTGGCC<br>AAGAAGCACCCCAAGACCTGGGTGCACTATATCGCCGCCGAGGAAGAGGACTGGGATTACGCTCCTCTGGTGCTGGCCCCTGACGACAGAAGCTACAA<br>GAGCCAGTACCTGAACAACGGCCCTCAGCGGATCGGCCGGAAGTATAAGAAAGTGCGGTTCATGGCCTACACCGACGAGACATTCAAGACCAGAGAGG<br>CCATCCAGCACGAGAGCGGAATTCTGGGCCCTCTGCTGTATGGCGAAGTGGGCGATACACTGCTGATCATCTTCAAGAACCAGGCCAGCAGACCCTAC<br>AACATCTACCCTCACGGCATCACCGATGTGCGGCCCCTGTATTCTAGAAGGCTGCCCAAGGGCGTGAAGCACCTGAAGGACTTCCCTATCCTGCCTGG<br>CGAGATTTTCAAGTACAAGTGGACCGTGACCGTGGAAGATGGCCCCACCAAGAGCGACCCTAGATGTCTGACACGGTACTACAGCAGCTTCGTGAACA<br>TGGAACGCGACCTGGCCAGCGGCCTGATTGGACCTCTGCTGATCTGCTACAAAGAAAGCGTGGACCAGCGGGGCAACCAGATCATGAGCGACAAGCGG<br>AACGTGATCCTGTTTAGCGTGTTCGATGAGAACCGGTCCTGGTATCTGACCGAGAACATCCAGCGGTTTCTGCCCAATCCTGCCGGGGTGCAACTGGA<br>AGATCCTGAGTTCCAGGCAAGCAACATCATGCACTCCATCAATGGCTATGTGTTCGACAGCCTGCAGCTGAGCGTGTGCCTGCACGAAGTGGCCTACT<br>GGTACATCCTGAGCATTGGCGCCCAGACCGACTTCCTGTCCGTGTTCTTTAGCGGCTACACCTTCAAGCACAAGATGGTGTACGAGGATACCCTGACA<br>CTGTTCCCATTCAGCGGCGAGACAGTGTTCATGAGCATGGAAAACCCCGGCCTGTGGATTCTGGGCTGTCACAACAGCGACTTCCGGAACAGAGGCAT<br>GACAGCCCTGCTGAAGGTGTCCAGCTGCGACAAGAACACCGGCGACTACTACGAGGACAGCTATGAGGACATCAGCGCCTACCTGCTGAGCAAGAACA<br>ATGCCATCGAGCCTCGGAGCTTCAGCCAGAATCCTCCTGTGCTGAAGCGGCACCAGCGCGAGATCACCAGAACAACCCTGCAGAGCGACCAAGAGGAA<br>ATCGATTACGACGACACCATCAGCGTCGAGATGAAGAAAGAAGATTTCGACATCTACGACGAGGACGAGAATCAGAGCCCCAGAAGCTTTCAGAAAAA<br>GACCCGGCACTACTTCATTGCCGCCGTCGAGAGACTGTGGGACTACGGCATGTCTAGCAGCCCTCACGTGCTGAGAAATAGAGCCCAGAGCGGCAGCG<br>TGCCCCAGTTCAAGAAAGTGGTGTTCCAAGAGTTCACCGACGGCAGCTTCACCCAGCCACTGTATAGAGGCGAGCTGAACGAGCATCTGGGCCTGCTG |

TABLE 9-continued

| ceDNA Vector Name | Nucleic Acid Sequence |
|---|---|
| | GGCCCTTATATCAGAGCCGAAGTGGAAGATAACATCATGGTCACCTTCCGGAATCAGGCTAGCCGGCCTTACAGCTTCTACAGCTCCCTGATCAGCTA<br>CGAAGAGGACCAGAGACAGGGCGCTGAGCCCAGAAAGAACTTCGTGAAGCCCAACGAGACTAAGACCTACTTTTGGAAGGTGCAGCACCACATGGCCC<br>CTACAAAGGACGAGTTCGACTGCAAAGCCTGGGCCTACTTCTCCGATGTGGATCTGGAAAAGGACGTGCACAGCGGGCTCATCGGACCACTGCTTGTG<br>TGCCACACCAACACACTGAACCCCGCTCACGGCAGACAAGTGACAGTGCAAGAGTTCGCCCTGTTCTTCACCATCTTCGACGAAACAAAGAGCTGGTA<br>CTTCACCGAGAATATGGAACGGAACTGCAGAGCCCCTTGCAACATCCAGATGGAAGATCCCACCTTCAAAGAGAACTACCGGTTCCACGCCATCAACG<br>GCTACATCATGGACACACTGCCCGGCCTGGTTATGGCCCAGGATCAGAGAATCCGGTGGTATCTGCTGTCCATGGGCTCCAACGAGAATATCCACAGC<br>ATCCACTTCAGCGGCCACGTGTTCACCGTGCGGAAAAAAGAAGAGTACAAAATGGCCCTGTACAATCTGTACCCTGGGGTGTTCGAAACCGTGGAAAT<br>GCTGCCTTCCAAGGCCGGCATTTGGAGAGTGGAATGTCTGATTGGAGAGCACCTCCACGCCGGAATGAGCACCCTGTTTCTGGTGTACAGCAACAAGT<br>GTCAGACCCCTCTCGGCATGGCCTCTGGACACATCAGAGACTTCCAGATCACCGCCTCTGGCCAGTACGGACAGTGGGCTCCTAAACTGGCTCGGCTG<br>CACTACAGCGGCAGCATCAATGCCTGGTCCACCAAAGAGCCCTTCAGCTGGATCAAGGTGGACCTGCTGGCTCCCATGATCATCCACGGAATCAAGAC<br>CCAGGGCGCCAGACAGAAGTTCAGCAGCCTGTACATCAGCCAGTTCATCATCATGTACAGCCTGGACGGCAAGAAGTGGCAGACCTACAGAGGCAACA<br>GCACCGGCACACTCATGGTGTTCTTCGGCAACGTGGACTCCAGCGGCATTAAGCACAACATCTTCAACCCTCCAATCATTGCCCGGTACATCCGGCTG<br>CACCCCACACACTACAGCATCCGGTCTACCCTGAGAATGGAACTGATGGGCTGCGACCTGAACAGCTGCTCTATGCCCCTCGGAATGGAAAGCAAGGC<br>CATCAGCGACGCCCAGATCACAGCCAGCAGCTACTTCACCAACATGTTCGCCACTTGGAGCCCCTCCAAGGCTAGACTGCATCTGCAGGGCAGAAGCA<br>ACGCTTGGAGGCCCCAAGTGAACAACCCCAAAGAGTGGCTGCAGGTTGACTTTCAAAAGACCATGAAAGTGACCGGCGTGACCACACAGGGCGTCAAG<br>TCTCTGCTGACCTCTATGTACGTGAAAGAGTTCCTGATCTCCAGCAGCCAGGACGGCCATCAGTGGACCCTGTTTTTCCAGAACGGCAAAGTGAAAGT<br>GTTCCAGGGCAATCAGGACAGCTTCACACCCGTGGTCAATTCTCTGGACCCTCCACTGCTGACCAGATACCTGCGGATTCACCCTCAGTCTTGGGTGC<br>ACCAGATCGCTCTGCGGATGGAAGTGCTGGGCTGTGAAGCTCAGGACCTCTACTAGTTAATTAAGAGCATCTTACCGCCATTTATTCCCATATTTGTT<br>CTGTTTTTCTTGATTTGGGTATACATTTAAATGTTAATAAAACAAAATGGTGGGGCAATCATTTACATTTTTAGGGATATGTAATTACTAGTTCAGGT<br>GTATTGCCACAAGACAAACATGTTAAGAAACTTTCCCGTTATTTACGCTCTGTTCCTGTTAATCAACCTCTGGATTACAAAATTTGTGAAAGATTGAC<br>TGATATTCTTAACTATGTTGCTCCTTTTACGCTGTGTGGATATGCTGCTTTATAGCCTCTGTATCTAGCTATTGCTTCCCGTACGGCTTTCGTTTTCT<br>CCTCCTTGTATAAATCCTGGTTGCTGTCTCTTTTAGAGGAGTTGTGGCCCGTTGTCCGTCAACGTGGCGTGGTGTGCTCTGTGTTTGCTGACGCAACC<br>CCCACTGGCTGGGGCATTGCCACCACCTGTCAACTCCTTTCTGGGACTTTCGCTTTCCCCCTCCCGATCGCCACGGCAGAACTCATCGCCGCCTGCCT<br>TGCCCGCTGCTGGACAGGGGCTAGGTTGCTGGGCACTGATAATTCCGTGGTGTTGTCTCCATAAAGTAGGAAACACTACACGATTCCATAAAGTAGGA<br>AACACTACATCACTCCATAAAGTAGGAAACACTACATGTGCCTTCTAGTTGCCAGCCATCTGTTGTTTGCCCCTCCCCCGTGCCTTCCTTGACCCTGG<br>AAGGTGCCACTCCCACTGTCCTTTCCTAATAAAATGAGGAAATTGCATCGCATTGTCTGAGTAGGTGTCATTCTATTCTGGGGGGTGGGGTGGGGCAG<br>GACAGCAAGGGGGAGGATTGGGAAGACAATAGCAGGCATGCTGGGGATGCGGTGGGCTCTATGGCTCTAGAGCATGGCTACGTAGATAAGTAGCATGG<br>CGGGTTAATCATTAACTACACCTGCAGGAGGAACCCCTAGTGATGGAGTTGGCCACTCCCTCTCTGCGCGCTCGCTCGCTCACTGAGGCCGGGCGACC<br>AAAGGTCGCCCGACGCCCGGGCGGCCTCAGTGAGCGAGCGAGCGCGCAGCTGCCTGCAGGGGCGCGCCTCGAGGCATGCGGTACCAAGCTTGTCGAGA<br>AGTACTAGAGGATCATAATCAGCCATACCACATTTGTAGAGGTTTTACTTGCTTTAAAAAACCTCCCACACCTCCCCCTGAACCTGAAACATAAAATG<br>AATGCAATTGTTGTTGTTAACTTGTTTATTGCAGCTTATAATGGTTACAAATAAAGCAATAGCATCACAAATTTCACAAATAAAGCATTTTTTTCACT<br>GCATTCTAGTTGTGGTTTGTCCAAACTCATCAATGTATCTTATCATGTCTGGATCTGATCACTGATATCGCCTAGGAGATCCGAACCAGATAAGTGAA<br>ATCTAGTTCCAAACTATTTTGTCATTTTTAATTTTCGTATTAGCTTACGACGCTACACCCAGTTCCCATCTATTTTGTCACTCTTCCCTAAATAATCC<br>TTAAAAACTCCATTTCCACCCCTCCCAGTTCCCAACTATTTTGTCCGCCCACAGCGGGGCATTTTTCTTCCTGTTATGTTTTTAATCAAACATCCTGC<br>CAACTCCATGTGACAAACCGTCATCTTCGGCTACTTTTTCTCTGTCACAGAATGAAAATTTTTCTGTCATCTCTTCGTTATTAATGTTTGTAATTGAC<br>TGAATATCAACGCTTATTTGCAGCCTGAATGGCGAATGGGACGCGCCCTGTAGCGGCGCATTAAGCGCGGCGGGTGTGGTGGTTACGCGCAGCGTGAC<br>CGCTACACTTGCCAGCGCCCTAGCGCCCGCTCCTTTCGCTTTCTTCCCTTCCTTTCTCGCCACGTTCGCCGGCTTTCCCCGTCAAGCTCTAAATCGGG<br>GGCTCCCTTTAGGGTTCCGATTTAGTGCTTTACGGCACCTCGACCCCAAAAAACTTGATTAGGGTGATGGTTCACGTAGTGGGCCATCGCCCTGATAG<br>ACGGTTTTTCGCCCTTTGACGTTGGAGTCCACGTTCTTTAATAGTGGACTCTTGTTCCAAACTGGAACAACACTCAACCCTATCTCGGTCTATTCTTT<br>TGATTTATAAGGGATTTTGCCGATTTCGGCCTATTGGTTAAAAAATGAGCTGATTTAACAAAAATTTAACGCGAATTTTAACAAAATATTAACGTTTA<br>CAATTTCAGGTGGCACTTTTCGGGGAAATGTGCGCGGAACCCCTATTTGTTTATTTTTCTAAATACATTCAAATATGTATCCGCTCATGAGACAATAA<br>CCCTGATAAATGCTTCAATAATATTGAAAAAGGAAGAGTATGAGTATTCAACATTTCCGTGTCGCCCTTATTCCCTTTTTTGCGGCATTTTGCCTTCC<br>TGTTTTTGCTCACCCAGAAACGCTGGTGAAAGTAAAAGATGCTGAAGATCAGTTGGGTGCACGAGTGGGTTACATCGAACTGGATCTCAACAGCGGTA<br>AGATCCTTGAGAGTTTTCGCCCCGAAGAACGTTTTCCAATGATGAGCACTTTTAAAGTTCTGCTATGTGGCGCGGTATTATCCCGTATTGACGCCGGG<br>CAAGAGCAACTCGGTCGCCGCATACACTATTCTCAGAATGACTTGGTTGAGTACTCACCAGTCACAGAAAAGCATCTTACGGATGGCATGACAGTAAG<br>AGAATTATGCAGTGCTGCCATAACCATGAGTGATAACACTGCGGCCAACTTACTTCTGACAACGATCGGAGGACCGAAGGAGCTAACCGCTTTTTTGC<br>ACAACATGGGGGATCATGTAACTCGCCTTGATCGTTGGGAACCGGAGCTGAATGAAGCCATACCAAACGACGAGCGTGACACCACGATGCCTGTAGCA<br>ATGGCAACAACGTTGCGCAAACTATTAACTGGCGAACTACTTACTCTAGCTTCCCGGCAACAATTAATAGACTGGATGGAGGCGGATAAAGTTGCAGG<br>ACCACTTCTGCGCTCGGCCCTTCCGGCTGGCTGGTTTATTGCTGATAAATCTGGAGCCGGTGAGCGTGGGTCTCGCGGTATCATTGCAGCACTGGGGC<br>CAGATGGTAAGCCCTCCCGTATCGTAGTTATCTACACGACGGGGAGTCAGGCAACTATGGATGAACGAAATAGACAGATCGCTGAGATAGGTGCCTCA |

TABLE 9-continued

| ceDNA Vector Name | Nucleic Acid Sequence |
|---|---|
| | CTGATTAAGCATTGGTAACTGTCAGACCAAGTTTACTCATATATACTTTAGATTGATTTAAAACTTCATTTTTAATTTAAAAGGATCTAGGTGAAGAT<br>CCTTTTTGATAATCTCATGACCAAAATCCCTTAACGTGAGTTTTCGTTCCACTGAGCGTCAGACCCCGTAGAAAAGATCAAAGGATCTTCTTGAGATC<br>CTTTTTTTCTGCGCGTAATCTGCTGCTTGCAAACAAAAAAACCACCGCTACCAGCGGTGGTTTGTTTGCCGGATCAAGAGCTACCAACTCTTTTTCCG<br>AAGGTAACTGGCTTCAGCAGAGCGCAGATACCAAATACTGTCCTTCTAGTGTAGCCGTAGTTAGGCCACCACTTCAAGAACTCTGTAGCACCGCCTAC<br>ATACCTCGCTCTGCTAATCCTGTTACCAGTGGCTGCTGCCAGTGGCGATAAGTCGTGTCTTACCGGGTTGGACTCAAGACGATAGTTACCGGATAAGG<br>CGCAGCGGTCGGGCTGAACGGGGGGTTCGTGCACACAGCCCAGCTTGGAGCGAACGACCTACACCGAACTGAGATACCTACAGCGTGAGCATTGAGAA<br>AGCGCCACGCTTCCCGAAGGGAGAAAGGCGGACAGGTATCCGGTAAGCGGCAGGGTCGGAACAGGAGAGCGCACGAGGGAGCTTCCAGGGGGAAACGC<br>CTGGTATCTTTATAGTCCTGTCGGGTTTCGCCACCTCTGACTTGAGCGTCGATTTTTGTGATGCTCGTCAGGGGGGCGGAGCCTATGGAAAAACGCCA<br>GCAACGCGGCCTTTTTACGGTTCCTGGCCTTTTGCTGGCCTTTTGCTCACATGTTCTTTCCTGCGTTATCCCCTGATTCTGTGGATAACCGTATTACC<br>GCCTTTGAGTGAGCTGATACCGCTCGCCGCAGCCGAACGACCGAGCGCAGCGAGTCAGTGAGCGAGGAAGCGGAAGAGCGCCTGATGCGGTATTTTCT<br>CCTTACGCATCTGTGCGGTATTTCACACCGCAGACCAGCCGCGTAACCTGGCAAAATCGGTTACGGTTGAGTAATAAATGGATGCCCTGCGTAAGCGG<br>GTGTGGGCGGACAATAAAGTCTTAAACTGAACAAAATAGATCTAAACTATGACAATAAAGTCTTAAACTAGACAGAATAGTTGTAAACTGAAATCAGT<br>CCAGTTATGCTGTGAAAAAGCATACTGGACTTTTGTTATGGCTAAAGCAAACTCTTCATTTTCTGAAGTGCAAATTGCCCGTCGTATTAAAGAGGGGC<br>GTGGCCAAGGGCATGGTAAAGACTATATTCGCGGCGTTGTGACAATTTACCGAACAACTCCGCGGCCGGGAAGCCGATCTCGGCTTGAACGAATTGTT<br>AGGTGGCGGTACTTGGGTCGATATCAAAGTGCATCACTTCTTCCCGTATGCCCAACTTTGTATAGAGAGCCACTGCGGGATCGTCACCGTAATCTGCT<br>TGCACGTAGATCACATAAGCACCAAGCGCGTTGGCCTCATGCTTGAGGAGATTGATGAGCGCGGTGGCAATGCCCTGCCTCCGGTGCTCGCCGGAGAC<br>TGCGAGATCATAGATATAGATCTCACTACGCGGCTGCTCAAACCTGGGCAGAACGTAAGCCGCGAGAGCGCCAACAACCGCTTCTTGGTCGAAGGCAG<br>CAAGCGCGATGAATGTCTTACTACGGAGCAAGTTCCCGAGGTAATCGGAGTCCGGCTGATGTTGGGAGTAGGTGGCTACGTCTCCGAACTCACGACCG<br>AAAAGATCAAGAGCAGCCCGCATGGATTTGACTTGGTCAGGGCCGAGCCTACATGTGCGAATGATGCCCATACTTGAGCCACCTAACTTTGTTTTAGG<br>GCGACTGCCCTGCTGCGTAACATCGTTGCTGCTGCGTAACATCGTTGCTGCTCCATAACATCAAACATCGACCCACGGCGTAACGCGCTTGCTGCTTG<br>GATGCCCGAGGCATAGACTGTACAAAAAAACAGTCATAACAAGCCATGAAAACCGCCACTGCGCCGTTACCACCGCTGCGTTCGGTCAAGGTTCTGGA<br>CCAGTTGCGTGAGCGCATACGCTACTTGCATTACAGTTTACGAACCGAACAGGCTTATGTCAACTGGGTTCGTGCCTTCATCCGTTTCCACGGTGTGC<br>GTCACCCGGCAACCTTGGGCAGCAGCGAAGTCGAGGCATTTCTGTCCTGGCTGGCGAACGAGCGCAAGGTTTCGGTCTCCACGCATCGTCAGGCATTG<br>GCGGCCTTGCTGTTCTTCTACGGCAAGGTGCTGTGCACGGATCTGCCCTGGCTTCAGGAGATCGGAAGACCTCGGCCGTCGCGGCGCTTGCCGGTGGT<br>GCTGACCCCGGATGAAGTGGTTCGCATCCTCGGTTTTCTGGAAGGCGAGCATCGTTTGTTCGCCCAGGACTCTAGCTATAGTTCTAGTGGTTGGCTAC<br>GTATACTCCGGAATATTAATAGATCATGGAGATAATTAAAATGATAACCATCTCGCAAATAAATAAGTATTTTACTGTTTTCGTAACAGTTTTGTAAT<br>AAAAAAACCTATAAATATTCCGGATTATTCATACCGTCCCACCATCGGGCGCGGATCTCGGTCCGAAACCATGTCGTACTACCATCACCATCACCATC<br>ACGATTACGATATCCCAACGACCGAAAACCTGTATTTTCAGGGCGCCATGGGATCC |
| ceDNAFVIII-vector 22 (SEQ ID NO: 213) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGA**GAGTCAATGGGAAAAACCCATTGGAGCCAAGTACACTGACTCAATAGGGACTTTCCATTGGGTTTTGCCCAGTACATAAGGTCAATAGGGGG**<br>**TGAGTCAACAGGAAAGTCCCATTGGAGCCAAGTACATTGAGTCAATAGGGACTTTCCAATGGGTTTTGCCCAGTACATAAGGTCAATGGGAGGTAAGC**<br>**CAATGGGTTTTTCCCATTACTGACATGTATACTGAGTCATTAGGGACTTTCCAATGGGTTTTGCC**CAGTACATAAGGTCAATAGGGGTGAATCAACAG<br>GAAAGTCCCATTGGAGCCAAGTACACTGAGTCAATAGGGACTTTCCATTGGGTTTTGCCCAGTACAAAAGGTCAATAGGGGGTGAGTCAATGGGTTTT<br>TCCCATTATTGGCACATACATAAGGTCAATAGGGGTGACTAGTGGAGAAGAGCATGCTTGAGGGCTGAGTGCCCCTCAGTGGGCAGAGAGCACATGGC<br>CCACAGTCCCTGAGAAGTTGGGGGGAGGGGTGGGCAATTGAACTGGTGCCTAGAGAAGGTGGGGCTTGGGTAAACTGGGAAAGTGATGTGGTGTACTG<br>GCTCCACCTTTTTCCCCAGGGTGGGGGAGAACCATATATAAGTGCAGTAGTCTCTGTGAACATTCAAGCTTCTGCCTTCTCCCTCCTGTGAGTTTGGT<br>AAGTCACTGACTGTCTATGCCTGGGAAAGGGTGGGCAGGAGATGGGGCAGTGCAGGAAAAGTGGCACTATGAACCCTGCAGCCCTAGACAATTGTACT<br>AACCTTCTTCTCTTTCCTCTCCTGACAGGTTGGTGTACAGTAGCTTCCGTTTAAACGCCGCCACCATGCAGATTGAGCTGAGCACCTGCTTCTTCCTG<br>TGCCTGCTGAGGTTCTGCTTCTCTGCCACCAGGAGATACTACCTGGGGGCTGTGGAGCTGAGCTGGGACTACATGCAGTCTGACCTGGGGGAGCTGCC<br>TGTGGATGCCAGGTTCCCCCCCAGAGTGCCCAAGAGCTTCCCCTTCAACACCTCTGTGGTGTACAAGAAGACCCTGTTTGTGGAGTTCACTGACCACC<br>TGTTCAACATTGCCAAGCCCAGGCCCCCCTGGATGGGCCTGCTGGGCCCCACCATCCAGGCTGAGGTGTATGACACTGTGGTGATCACCCTGAAGAAC<br>ATGGCCAGCCACCCTGTGAGCCTGCATGCTGTGGGGGTGAGCTACTGGAAGGCCTCTGAGGGGGCTGAGTATGATGACCAGACCAGCCAGAGGGAGAA<br>GGAGGATGACAAGGTGTTCCCTGGGGGCAGCCACACCTATGTGTGGCAGGTGCTGAAGGAGAATGGCCCCATGGCCTCTGACCCCCTGTGCCTGACCT<br>ACAGCTACCTGAGCCATGTGGACCTGGTGAAGGACCTGAACTCTGGCCTGATTGGGGCCCTGCTGGTGTGCAGGGAGGGCAGCCTGGCCAAGGAGAAG<br>ACCCAGACCCTGCACAAGTTCATCCTGCTGTTTGCTGTGTTTGATGAGGGCAAGAGCTGGCACTCTGAAACCAAGAACAGCCTGATGCAGGACAGGGA<br>TGCTGCCTCTGCCAGGGCCTGGCCCAAGATGCACACTGTGAATGGCTATGTGAACAGGAGCCTGCCTGGCCTGATTGGCTGCCACAGGAAGTCTGTGT<br>ACTGGCATGTGATTGGCATGGGCACCACCCCTGAGGTGCACAGCATCTTCCTGGAGGGCCACACCTTCCTGGTCAGGAACCACAGGCAGGCCAGCCTG<br>GAGATCAGCCCCATCACCTTCCTGACTGCCCAGACCCTGCTGATGGACCTGGGCCAGTTCCTGCTGTTCTGCCACATCAGCAGCCACCAGCATGATGG |

TABLE 9-continued

| ceDNA Vector Name | Nucleic Acid Sequence |
|---|---|
| | CATGGAGGCCTATGTGAAGGTGGACAGCTGCCCTGAGGAGCCCCAGCTGAGGATGAAGAACAATGAGGAGGCTGAGGACTATGATGATGACCTGACTG |
| | ACTCTGAGATGGATGTGGTGAGGTTTGATGATGACAACAGCCCCAGCTTCATCCAGATCAGGTCTGTGGCCAAGAAGCACCCCAAGACCTGGGTGCAC |
| | TACATTGCTGCTGAGGAGGAGGACTGGGACTATGCCCCCCTGGTGCTGGCCCCTGATGACAGGAGCTACAAGAGCCAGTACCTGAACAATGGCCCCCA |
| | GAGGATTGGCAGGAAGTACAAGAAGGTCAGGTTCATGGCCTACACTGATGAAACCTTCAAGACCAGGGAGGCCATCCAGCATGAGTCTGGCATCCTGG |
| | GCCCCCTGCTGTATGGGGAGGTGGGGGACACCCTGCTGATCATCTTCAAGAACCAGGCCAGCAGGCCCTACAACATCTACCCCCATGGCATCACTGAT |
| | GTGAGGCCCCTGTACAGCAGGAGGCTGCCCAAGGGGGTGAAGCACCTGAAGGACTTCCCCATCCTGCCTGGGGAGATCTTCAAGTACAAGTGGACTGT |
| | GACTGTGGAGGATGGCCCCACCAAGTCTGACCCCAGGTGCCTGACCAGATACTACAGCAGCTTTGTGAACATGGAGAGGGACCTGGCCTCTGGCCTGA |
| | TTGGCCCCCTGCTGATCTGCTACAAGGAGTCTGTGGACCAGAGGGGCAACCAGATCATGTCTGACAAGAGGAATGTGATCCTGTTCTCTGTGTTTGAT |
| | GAGAACAGGAGCTGGTACCTGACTGAGAACATCCAGAGGTTCCTGCCCAACCCTGCTGGGGTGCAGCTGGAGGACCCTGAGTTCCAGGCCAGCAACAT |
| | CATGCACAGCATCAATGGCTATGTGTTTGACAGCCTGCAGCTGTCTGTGTGCCTGCATGAGGTGGCCTACTGGTACATCCTGAGCATTGGGGCCCAGA |
| | CTGACTTCCTGTCTGTGTTCTTCTCTGGCTACACCTTCAAGCACAAGATGGTGTATGAGGACACCCTGACCCTGTTCCCCTTCTCTGGGGAGACTGTG |
| | TTCATGAGCATGGAGAACCCTGGCCTGTGGATTCTGGGCTGCCACAACTCTGACTTCAGGAACAGGGGCATGACTGCCCTGCTGAAAGTCTCCAGCTG |
| | TGACAAGAACACTGGGGACTACTATGAGGACAGCTATGAGGACATCTCTGCCTACCTGCTGAGCAAGAACAATGCCATTGAGCCCAGGAGCTTCAGCC |
| | AGAATGCCACTAATGTGTCTAACAACAGCAACACCAGCAATGACAGCAATGTGTCTCCCCCAGTGCTGAAGAGGCACCAGAGGGAGATCACCAGGACC |
| | ACCCTGCAGTCTGACCAGGAGGAGATTGACTATGATGACACCATCTCTGTGGAGATGAAGAAGGAGGACTTTGACATCTACGACGAGGACGAGAACCA |
| | GAGCCCCAGGAGCTTCCAGAAGAAGACCAGGCACTACTTCATTGCTGCTGTGGAGAGGCTGTGGGACTATGGCATGAGCAGCAGCCCCCATGTGCTGA |
| | GGAACAGGGCCCAGTCTGGCTCTGTGCCCCAGTTCAAGAAGGTGGTGTTCCAGGAGTTCACTGATGGCAGCTTCACCCAGCCCCTGTACAGAGGGGAG |
| | CTGAATGAGCACCTGGGCCTGCTGGGCCCCTACATCAGGGCTGAGGTGGAGGACAACATCATGGTGACCTTCAGGAACCAGGCCAGCAGGCCCTACAG |
| | CTTCTACAGCAGCCTGATCAGCTATGAGGAGGACCAGAGGCAGGGGGCTGAGCCCAGGAAGAACTTTGTGAAGCCCAATGAAACCAAGACCTACTTCT |
| | GGAAGGTGCAGCACCACATGGCCCCCACCAAGGATGAGTTTGACTGCAAGGCCTGGGCCTACTTCTCTGATGTGGACCTGGAGAAGGATGTGCACTCT |
| | GGCCTGATTGGCCCCCTGCTGGTGTGCCACACCAACACCCTGAACCCTGCCCATGGCAGGCAGGTGACTGTGCAGGAGTTTGCCCTGTTCTTCACCAT |
| | CTTTGATGAAACCAAGAGCTGGTACTTCACTGAGAACATGGAGAGGAACTGCAGGGCCCCCTGCAACATCCAGATGGAGGACCCCACCTTCAAGGAGA |
| | ACTACAGGTTCCATGCCATCAATGGCTACATCATGGACACCCTGCCTGGCCTGGTGATGGCCCAGGACCAGAGGATCAGGTGGTACCTGCTGAGCATG |
| | GGCAGCAATGAGAACATCCACAGCATCCACTTCTCTGGCCATGTGTTCACTGTGAGGAAGAAGGAGGAGTACAAGATGGCCCTGTACAACCTGTACCC |
| | TGGGGTGTTTGAGACTGTGGAGATGCTGCCCAGCAAGGCTGGCATCTGGAGGGTGGAGTGCCTGATTGGGGAGCACCTGCATGCTGGCATGAGCACCC |
| | TGTTCCTGGTGTACAGCAACAAGTGCCAGACCCCCCTGGGCATGGCCTCTGGCCACATCAGGGACTTCCAGATCACTGCCTCTGGCCAGTATGGCCAG |
| | TGGGCCCCCAAGCTGGCCAGGCTGCACTACTCTGGCAGCATCAATGCCTGGAGCACCAAGGAGCCCTTCAGCTGGATCAAGGTGGACCTGCTGGCCCC |
| | CATGATCATCCATGGCATCAAGACCCAGGGGGCCAGGCAGAAGTTCAGCAGCCTGTACATCAGCCAGTTCATCATCATGTACAGCCTGGATGGCAAGA |
| | AGTGGCAGACCTACAGGGGCAACAGCACTGGCACCCTGATGGTGTTCTTTGGCAATGTGGACAGCTCTGGCATCAAGCACAACATCTTCAACCCCCCC |
| | ATCATTGCCAGATACATCAGGCTGCACCCCACCCACTACAGCATCAGGAGCACCCTGAGGATGGAGCTGATGGGCTGTGACCTGAACAGCTGCAGCAT |
| | GCCCCTGGGCATGGAGAGCAAGGCCATCTCTGATGCCCAGATCACTGCCAGCAGCTACTTCACCAACATGTTTGCCACCTGGAGCCCCAGCAAGGCCA |
| | GGCTGCACCTGCAGGGCAGGAGCAATGCCTGGAGGCCCCAGGTCAACAACCCCAAGGAGTGGCTGCAGGTGGACTTCCAGAAGACCATGAAGGTGACT |
| | GGGGTGACCACCCAGGGGGTGAAGAGCCTGCTGACCAGCATGTATGTGAAGGAGTTCCTGATCAGCAGCAGCCAGGATGGCCACCAGTGGACCCTGTT |
| | CTTCCAGAATGGCAAGGTGAAGGTGTTCCAGGGCAACCAGGACAGCTTCACCCCTGTGGTGAACAGCCTGGACCCCCCCCTGCTGACCAGATACCTGA |
| | GGATTCACCCCCAGAGCTGGGTGCACCAGATTGCCCTGAGGATGGAGGTGCTGGGCTGTGAGGCCCAGGACCTGTACTGATTAATTAAGAGCATCTTA |
| | CCGCCATTTATTCCATATTTGTTCTGTTTTTCTTGATTTGGGTATACATTTAAATGTTAATAAAACAAAATGGTGGGGCAATCATTTACATTTTTAG |
| | GGATATGTAATTACTAGTTCAGGTGTATTGCCACAAGACAAACATGTTAAGAAACTTTCCCGTTATTTACGCTCTGTTCCTGTTAATCAACCTCTGGA |
| | TTACAAAATTTGTGAAAGATTGACTGATATTCTTAACTATGTTGCTCCTTTTACGCTGTGTGGATATGCTGCTTTATAGCCTCTGTATCTAGCTATTG |
| | CTTCCCGTACGGCTTTCGTTTTCTCCTCCTTGTATAAATCCTGGTTGCTGTCTCTTTTAGAGGAGTTGTGGCCCGTTGTCCGTCAACGTGGCGTGGTG |
| | TGCTCTGTGTTTGCTGACGCAACCCCCACTGGCTGGGGCATTGCCACCACCTGTCAACTCCTTTCTGGGACTTTCGCTTTCCCCCTCCCGATCGCCAC |
| | GGCAGAACTCATCGCCGCCTGCCTTGCCCGCTGCTGGACAGGGGCTAGGTTGCTGGGCACTGATAATTCCGTGGTGTTGTCTCCATAAAGTAGGAAAC |
| | ACTACACGATTCCATAAAGTAGGAAACACTACATCACTCCATAAAGTAGGAAACACTACATGTGCCTTCTAGTTGCCAGCCATCTGTTGTTTGCCCCT |
| | CCCCCGTGCCTTCCTTGACCCTGGAAGGTGCCACTCCCACTGTCCTTTCCTAATAAAATGAGGAAATTGCATCGCATTGTCTGAGTAGGTGTCATTCT |
| | ATTCTGGGGGGTGGGGTGGGGCAGGACAGCAAGGGGGAGGATTGGGAAGACAATAGCAGGCATGCTGGGGATGCGGTGGGCTCTATGGCTCTAGATCT |
| | AGAGCATGGCTACGTAGATAAGTAGCATGGCGGGTTAATCATTAACTACACCTGCAGGAGGAACCCCTAGTGATGGAGTTGGCCACTCCCTCTCTGCG |
| | CGCTCGCTCGCTCACTGAGGCCGGGCGACCAAAGGTCGCCCGACGCCCGGGCGGCCTCAGTGAGCGAGCGAGCGCGCAGCTGCCTGCAGGGGCGCGCC |
| | TCGAGGCATGCGGTACCAAGCTTGTCGAGAAGTACTAGAGGATCATAATCAGCCATACCACATTTGTAGAGGTTTTACTTGCTTTAAAAAACCTCCCA |
| | CACCTCCCCCTGAACCTGAAACATAAAATGAATGCAATTGTTGTTGTTAACTTGTTTATTGCAGCTTATAATGGTTACAAATAAAGCAATAGCATCAC |
| | AAATTTCACAAATAAAGCATTTTTTTCACTGCATTCTAGTTGTGGTTTGTCCAAACTCATCAATGTATCTTATCATGTCTGGATCTGATCACTGATAT |
| | CGCCTAGGAGATCCGAACCAGATAAGTGAAATCTAGTTCCAAACTATTTTGTCATTTTTAATTTTCGTATTAGCTTACGACGCTACACCCAGTTCCCA |

TABLE 9-continued

| ceDNA Vector Name | Nucleic Acid Sequence |
|---|---|
| | TCTATTTTGTCACTCTTCCCTAAATAATCCTTAAAAACTCCATTTCCACCCCTCCCAGTTCCCAACTATTTTGTCCGCCCACAGCGGGGCATTTTTCT<br>TCCTGTTATGTTTTTAATCAAACATCCTGCCAACTCCATGTGACAAACCGTCATCTTCGGCTACTTTTTCTCTGTCACAGAATGAAAATTTTTCTGTC<br>ATCTCTTCGTTATTAATGTTTGTAATTGACTGAATATCAACGCTTATTTGCAGCCTGAATGGCGAATGGGACGCGCCCTGTAGCGGCGCATTAAGCGC<br>GGCGGGTGTGGTGGTTACGCGCAGCGTGACCGCTACACTTGCCAGCGCCCTAGCGCCCGCTCCTTTCGCTTTCTTCCCTTCCTTTCTCGCCACGTTCG<br>CCGGCTTTCCCCGTCAAGCTCTAAATCGGGGGCTCCCTTTAGGGTTCCGATTTAGTGCTTTACGGCACCTCGACCCCAAAAAACTTGATTAGGGTGAT<br>GGTTCACGTAGTGGGCCATCGCCCTGATAGACGGTTTTTCGCCCTTTGACGTTGGAGTCCACGTTCTTTAATAGTGGACTCTTGTTCCAAACTGGAAC<br>AACACTCAACCCTATCTCGGTCTATTCTTTTGATTTATAAGGGATTTTGCCGATTTCGGCCTATTGGTTAAAAAATGAGCTGATTTAACAAAAATTTA<br>ACGCGAATTTTAACAAAATATTAACGTTTACAATTTCAGGTGGCACTTTTCGGGGAAATGTGCGCGGAACCCCTATTTGTTTATTTTTCTAAATACAT<br>TCAAATATGTATCCGCTCATGAGACAATAACCCTGATAAATGCTTCAATAATATTGAAAAAGGAAGAGTATGAGTATTCAACATTTCCGTGTCGCCCT<br>TATTCCCTTTTTTGCGGCATTTTGCCTTCCTGTTTTTGCTCACCCAGAAACGCTGGTGAAAGTAAAAGATGCTGAAGATCAGTTGGGTGCACGAGTGG<br>GTTACATCGAACTGGATCTCAACAGCGGTAAGATCCTTGAGAGTTTTCGCCCCGAAGAACGTTTTCCAATGATGAGCACTTTTAAAGTTCTGCTATGT<br>GGCGCGGTATTATCCCGTATTGACGCCGGGCAAGAGCAACTCGGTCGCCGCATACACTATTCTCAGAATGACTTGGTTGAGTACTCACCAGTCACAGA<br>AAAGCATCTTACGGATGGCATGACAGTAAGAGAATTATGCAGTGCTGCCATAACCATGAGTGATAACACTGCGGCCAACTTACTTCTGACAACGATCG<br>GAGGACCGAAGGAGCTAACCGCTTTTTTGCACAACATGGGGGATCATGTAACTCGCCTTGATCGTTGGGAACCGGAGCTGAATGAAGCCATACCAAAC<br>GACGAGCGTGACACCACGATGCCTGTAGCAATGGCAACAACGTTGCGCAAACTATTAACTGGCGAACTACTTACTCTAGCTTCCCGGCAACAATTAAT<br>AGACTGGATGGAGGCGGATAAAGTTGCAGGACCACTTCTGCGCTCGGCCCTTCCGGCTGGCTGGTTTATTGCTGATAAATCTGGAGCCGGTGAGCGTG<br>GGTCTCGCGGTATCATTGCAGCACTGGGGCCAGATGGTAAGCCCTCCCGTATCGTAGTTATCTACACGACGGGGAGTCAGGCAACTATGGATGAACGA<br>AATAGACAGATCGCTGAGATAGGTGCCTCACTGATTAAGCATTGGTAACTGTCAGACCAAGTTTACTCATATATACTTTAGATTGATTTAAAACTTCA<br>TTTTTAATTTAAAAGGATCTAGGTGAAGATCCTTTTTGATAATCTCATGACCAAAATCCCTTAACGTGAGTTTTCGTTCCACTGAGCGTCAGACCCCG<br>TAGAAAAGATCAAAGGATCTTCTTGAGATCCTTTTTTTCTGCGCGTAATCTGCTGCTTGCAAACAAAAAAACCACCGCTACCAGCGGTGGTTTGTTTG<br>CCGGATCAAGAGCTACCAACTCTTTTTCCGAAGGTAACTGGCTTCAGCAGAGCGCAGATACCAAATACTGTCCTTCTAGTGTAGCCGTAGTTAGGCCA<br>CCACTTCAAGAACTCTGTAGCACCGCCTACATACCTCGCTCTGCTAATCCTGTTACCAGTGGCTGCTGCCAGTGGCGATAAGTCGTGTCTTACCGGGT<br>TGGACTCAAGACGATAGTTACCGGATAAGGCGCAGCGGTCGGGCTGAACGGGGGGTTCGTGCACACAGCCCAGCTTGGAGCGAACGACCTACACCGAA<br>CTGAGATACCTACAGCGTGAGCATTGAGAAAGCGCCACGCTTCCCGAAGGGAGAAAGGCGGACAGGTATCCGGTAAGCGGCAGGGTCGGAACAGGAGA<br>GCGCACGAGGGAGCTTCCAGGGGGAAACGCCTGGTATCTTTATAGTCCTGTCGGGTTTCGCCACCTCTGACTTGAGCGTCGATTTTTGTGATGCTCGT<br>CAGGGGGGCGGAGCCTATGGAAAAACGCCAGCAACGCGGCCTTTTTACGGTTCCTGGCCTTTTGCTGGCCTTTTGCTCACATGTTCTTTCCTGCGTTA<br>TCCCCTGATTCTGTGGATAACCGTATTACCGCCTTTGAGTGAGCTGATACCGCTCGCCGCAGCCGAACGACCGAGCGCAGCGAGTCAGTGAGCGAGGA<br>AGCGGAAGAGCGCCTGATGCGGTATTTTCTCCTTACGCATCTGTGCGGTATTTCACACCGCAGACCAGCCGCGTAACCTGGCAAAATCGGTTACGGTT<br>GAGTAATAAATGGATGCCCTGCGTAAGCGGGTGTGGGCGGACAATAAAGTCTTAAACTGAACAAAATAGATCTAAACTATGACAATAAAGTCTTAAAC<br>TAGACAGAATAGTTGTAAACTGAAATCAGTCCAGTTATGCTGTGAAAAAGCATACTGGACTTTTGTTATGGCTAAAGCAAACTCTTCATTTTCTGAAG<br>TGCAAATTGCCCGTCGTATTAAAGAGGGGCGTGGCCAAGGGCATGGTAAAGACTATATTCGCGGCGTTGTGACAATTTACCGAACAACTCCGCGGCCG<br>GGAAGCCGATCTCGGCTTGAACGAATTGTTAGGTGGCGGTACTTGGGTCGATATCAAAGTGCATCACTTCTTCCCGTATGCCCAACTTTGTATAGAGA<br>GCCACTGCGGGATCGTCACCGTAATCTGCTTGCACGTAGATCACATAAGCACCAAGCGCGTTGGCCTCATGCTTGAGGAGATTGATGAGCGCGGTGGC<br>AATGCCCTGCCTCCGGTGCTCGCCGGAGACTGCGAGATCATAGATATAGATCTCACTACGCGGCTGCTCAAACCTGGGCAGAACGTAAGCCGCGAGAG<br>CGCCAACAACCGCTTCTTGGTCGAAGGCAGCAAGCGCGATGAATGTCTTACTACGGAGCAAGTTCCCGAGGTAATCGGAGTCCGGCTGATGTTGGGAG<br>TAGGTGGCTACGTCTCCGAACTCACGACCGAAAAGATCAAGAGCAGCCCGCATGGATTTGACTTGGTCAGGGCCGAGCCTACATGTGCGAATGATGCC<br>CATACTTGAGCCACCTAACTTTGTTTTAGGGCGACTGCCCTGCTGCGTAACATCGTTGCTGCTGCGTAACATCGTTGCTGCTCCATAACATCAAACAT<br>CGACCCACGGCGTAACGCGCTTGCTGCTTGGATGCCCGAGGCATAGACTGTACAAAAAAACAGTCATAACAAGCCATGAAAACCGCCACTGCGCCGTT<br>ACCACCGCTGCGTTCGGTCAAGGTTCTGGACCAGTTGCGTGAGCGCATACGCTACTTGCATTACAGTTTACGAACCGAACAGGCTTATGTCAACTGGG<br>TTCGTGCCTTCATCCGTTTCCACGGTGTGCGTCACCCGGCAACCTTGGGCAGCAGCGAAGTCGAGGCATTTCTGTCCTGGCTGGCGAACGAGCGCAAG<br>GTTTCGGTCTCCACGCATCGTCAGGCATTGGCGGCCTTGCTGTTCTTCTACGGCAAGGTGCTGTGCACGGATCTGCCCTGGCTTCAGGAGATCGGAAG<br>ACCTCGGCCGTCGCGGCGCTTGCCGGTGGTGCTGACCCCGGATGAAGTGGTTCGCATCCTCGGTTTTCTGGAAGGCGAGCATCGTTTGTTCGCCCAGG<br>ACTCTAGCTATAGTTCTAGTGGTTGGCTACGTATACTCCGGAATATTAATAGATCATGGAGATAATTAAAATGATAACCATCTCGCAAATAAATAAGT<br>ATTTTACTGTTTTCGTAACAGTTTTGTAATAAAAAAACCTATAAATATTCCGGATTATTCATACCGTCCCACCATCGGGCGCGGATCTCGGTCCGAAA<br>CCATGTCGTACTACCATCACCATCACCATCACGATTACGATATCCCAACGACCGAAAACCTGTATTTTCAGGGCGCCATGGGATCC |
| ceDNAFVIII-vector 23 (SEQ ID NO: 214) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGA**CGGGGGAGGCTGCTGGTGAATATTAACCAAGGTCACCCCAGTTATCGGAGGAGCAAACAGGGGCTAAGTCCACACGCGTGGTACCGTCTGTC**<br>**TGCACATTTCGTAGAGCGAGTGTTCCGATACTCTAATCTCCCTAGGCAAGGTTCATATTTGTGTAGGTTACTTATTCTCCTTTTGTTGACTAAGTCAA** |

TABLE 9-continued

| ceDNA Vector Name | Nucleic Acid Sequence |
|---|---|
| | **TAATCAGAATCAGCAGGTTTGGAGTCAGCTTGGCAGGGATCAGCAGCCTGGGTTGGAAGGAGGGG**GTATAAAAGCCCCTTCACCAGGAGAAGCCGTCA<br>CACAGATCCACAAGCTCCTGAAGAGGTAAGGGTTTAAGGGATGGTTGGTTGGTGGGGTATTAATGTTTAATTACCTGGAGCACCTGCCTGAAATCACT<br>TTTTTTCAGGTTGGTTTAAACGCCGCCACCATGCAAATTGAGTTAAGTACCTGTTTTTCCTGTGCCTGTTGAGATTTTGCTTCTCTGCTACCAGAAG<br>GTATTACCTGGGAGCTGTGGAGCTGTCATGGGACTACATGCAGTCTGACCTGGGAGAGCTCCCTGTTGATGCTAGGTTTCCCCCTAGGGTGCCAAAGT<br>CCTTTCCTTTTAACACCTCAGTGGTGTACAAGAAGACACTGTTTGTGGAGTTTACTGACCACCTCTTCAATATTGCTAAGCCAAGACCCCCTTGGATG<br>GGTCTCTTGGGCCCTACCATCCAGGCTGAGGTTTATGATACAGTGGTGATTACCCTCAAGAATATGGCTTCTCATCCTGTTAGTCTGCATGCAGTAGG<br>GGTCAGCTATTGGAAGGCCAGTGAAGGAGCTGAGTATGATGACCAGACCAGCCAGAGAGAGAAAGAGGATGACAAGGTGTTCCCTGGGGGATCACACA<br>CCTATGTGTGGCAGGTGTTGAAGGAAAATGGACCCATGGCCTCTGACCCACTCTGCCTGACTTACTCCTACCTGTCTCATGTGGACCTGGTCAAAGAT<br>CTGAACTCTGGCCTGATTGGGGCACTGTTGGTGTGCAGAGAAGGGTCTCTTGCCAAGGAGAAGACTCAGACCCTGCACAAGTTCATCCTGCTGTTTGC<br>TGTGTTTGATGAAGGCAAGTCTTGGCATTCTGAGACTAAGAACAGCCTGATGCAAGATAGAGATGCTGCATCTGCCAGGGCCTGGCCTAAGATGCACA<br>CTGTGAATGGATATGTGAATAGGTCCTTGCCTGGCCTGATTGGATGCCATAGGAAGTCTGTGTACTGGCATGTGATTGGCATGGGCACCACCCCTGAG<br>GTTCACTCTATTTTTCTGGAGGGCCATACTTTCCTTGTGAGGAATCATAGACAGGCCTCTCTGGAGATTAGCCCTATTACATTTCTGACTGCTCAGAC<br>CCTCCTCATGGACTTGGGGCAGTTTCTGTTAAGCTGCCACATCAGCAGCCATCAACATGATGGTATGGAAGCCTATGTCAAAGTGGATAGCTGCCCTG<br>AAGAACCACAGCTTAGGATGAAGAACAATGAGGAGGCAGAGGACTATGATGATGATCTGACTGATTCTGAAATGGATGTGGTGAGATTTGATGATGAT<br>AATAGCCCTTCCTTTATCCAGATCAGGTCAGTGGCCAAGAAGCACCCAAAGACCTGGGTGCATTATATTGCTGCTGAGGAGGAGGACTGGGACTATGC<br>CCCTCTGGTGCTGGCCCCTGATGATAGAAGCTATAAGTCTCAATACTTGAATAATGGCCCACAGAGGATTGGGAGAAAGTACAAAAAGGTGAGATTTA<br>TGGCCTACACTGATGAGACTTTCAAGACCAGAGAGGCCATCCAGCATGAATCAGGCATTTTGGGTCCCCTGCTGTATGGAGAGGTGGGGGATACCCTG<br>CTGATCATCTTTAAGAACCAGGCCAGCAGACCTTACAACATTTACCCTCATGGGATCACAGATGTGAGGCCACTCTACTCTAGGAGATTGCCCAAGGG<br>AGTCAAGCATCTTAAGGACTTTCCAATCCTGCCTGGGGAGATCTTCAAGTACAAATGGACAGTGACAGTTGAGGATGGACCTACTAAGAGTGACCCCA<br>GGTGTCTGACCAGATATTACTCTAGCTTTGTCAATATGGAAAGAGACCTGGCTTCAGGCTTGATAGGCCCTCTTCTCATCTGCTACAAAGAGTCTGTG<br>GACCAGAGAGGAAATCAGATTATGTCTGACAAGAGAAATGTTATTCTGTTTTCAGTCTTTGATGAGAACAGAAGTTGGTACTTGACAGAGAACATTCA<br>GAGATTTCTGCCTAACCCTGCAGGAGTGCAGCTTGAGGACCCTGAGTTTCAGGCTTCCAATATCATGCATTCTATCAATGGCTATGTGTTTGATAGCC<br>TGCAGCTGTCTGTGTGCCTGCATGAGGTTGCCTATTGGTACATCCTGTCTATTGGGGCCCAAACTGATTTCTTGTCTGTGTTTTTCAGTGGATATACC<br>TTTAAGCATAAGATGGTGTATGAAGATACCTTGACACTTTTCCCTTTCTCAGGAGAGACTGTCTTCATGTCTATGGAGAACCCTGGACTGTGGATCCT<br>GGGATGCCACAACTCAGACTTCAGAAACAGGGGTATGACAGCTCTGCTTAAGGTCTCCTCATGTGACAAAAATACAGGAGACTACTATGAAGATTCCT<br>ATGAGGACATCTCTGCTTACCTGCTCAGCAAAAACAATGCCATTGAGCCCAGAAGCTTCAGCCAGAATTCCAGACATCCCAGTACTAGGCAGAAGCAG<br>TTTAATGCCACCACCATCCCAGAAAATGACATTGAGAAGACAGACCCTTGGTTTGCCCATAGAACCCCAATGCCCAAGATTCAGAATGTGAGCAGCTC<br>AGACTTGCTGATGCTGCTGAGGCAGTCTCCTACTCCCCATGGCCTGTCCCTCTCAGATCTGCAGGAAGCCAAGTATGAGACATTTTCTGATGACCCCT<br>CCCCAGGGGCTATTGACAGTAACAACAGCCTGTCTGAAATGACCCACTTCAGACCTCAGCTCCACCACAGTGGGGATATGGTGTTTACCCCAGAGTCA<br>GGCCTGCAGCTGAGACTGAATGAGAAGCTGGGAACCACAGCTGCCACAGAACTGAAGAAGCTGGATTTCAAGGTGAGCTCTACTTCAAATAATCTGAT<br>TTCCACTATCCCATCTGACAATTTGGCAGCTGGCACTGACAATACAAGCTCTCTGGGCCCACCTAGCATGCCAGTGCATTATGACAGCCAGTTGGACA<br>CCACTCTTTTTGGAAAGAAATCCAGTCCCCTGACAGAGTCAGGAGGACCCCTTTCTCTGTCTGAGGAGAACAATGATAGTAAGCTTCTGGAGTCAGGC<br>TTGATGAACTCCCAGGAGAGTTCTTGGGGCAAGAATGTGAGCTCTAGGGAGATCACCAGAACCACTCTGCAGTCTGACCAAGAAGAGATTGATTATGA<br>TGACACTATCTCTGTTGAGATGAAGAAGGAGGACTTTGATATCTATGATGAGGATGAGAACCAGTCTCCAAGAAGTTTCCAGAAGAAGACCAGGCACT<br>ACTTTATTGCTGCTGTGGAGAGACTGTGGGACTATGGAATGTCCTCCTCCCCTCATGTCCTGAGAAATAGAGCTCAGTCAGGATCAGTGCCCCAGTTC<br>AAGAAGGTGGTGTTCCAGGAATTCACAGATGGAAGTTTTACCCAGCCACTGTATAGAGGTGAACTGAATGAACATCTGGGTCTGCTGGGGCCCTATAT<br>CAGGGCTGAGGTGGAGGACAATATTATGGTGACCTTTAGAAACCAGGCCTCAAGGCCCTACAGCTTCTACTCTTCCCTCATTTCATATGAGGAAGACC<br>AGAGACAGGGAGCAGAGCCTAGAAAGAACTTTGTCAAGCCCAATGAAACCAAAACCTATTTCTGGAAGGTGCAGCACCACATGGCACCCACCAAAGAT<br>GAGTTTGACTGCAAAGCCTGGGCCTATTTCTCAGATGTGGATCTGGAGAAGGATGTCCATTCAGGTCTGATTGGACCACTCCTGGTGTGCCACACCAA<br>CACACTGAATCCAGCTCATGGCAGACAGGTGACAGTCCAGGAGTTTGCCCTGTTTTTCACTATTTTTGATGAGACCAAGAGCTGGTATTTTACAGAGA<br>ATATGGAAAGAAACTGCAGAGCCCCTTGTAATATCCAGATGGAGGACCCAACCTTTAAGGAGAACTACAGGTTCCATGCCATCAATGGCTACATTATG<br>GATACCCTGCCTGGCCTGGTTATGGCCCAGGATCAGAGGATCAGGTGGTATCTGCTGTCAATGGGCTCCAATGAGAACATTCATAGTATTCACTTTTC<br>AGGACATGTGTTCACAGTGAGAAAGAAGGAGGAGTATAAGATGGCCCTCTATAATCTCTACCCAGGGGTGTTTGAGACAGTTGAGATGCTGCCATCTA<br>AGGCAGGCATCTGGAGAGTGGAATGCCTCATTGGAGAGCACCTGCATGCTGGCATGTCCACCCTGTTTCTGGTGTACTCCAACAAATGTCAGACCCCT<br>CTTGGTATGGCCTCTGGCCACATTAGGGATTTCCAGATTACTGCCAGTGGTCAGTATGGGCAGTGGGCCCCTAAGCTGGCCAGACTGCACTATTCTGG<br>GAGCATCAATGCCTGGTCCACCAAGGAACCTTTTTCTTGGATTAAAGTGGATCTGCTGGCCCCAATGATCATCCATGGGATCAAGACCCAGGGAGCTA<br>GGCAGAAGTTCAGCAGCCTGTACATTAGTCAGTTCATCATTATGTACAGTCTGGATGGCAAAAAGTGGCAGACATACAGGGGCAATTCCACTGGAACC<br>CTGATGGTGTTCTTTGGAAATGTGGATAGCAGTGGTATCAAGCACAACATTTTCAACCCTCCCATCATTGCCAGGTACATCAGACTGCATCCAACCCA<br>CTACAGCATTAGGAGCACCCTTAGGATGGAGCTCATGGGGTGTGACCTGAACTCTTGCTCTATGCCACTTGGAATGGAGAGCAAGGCCATCTCTGATG<br>CCCAGATTACTGCTAGTTCCTACTTCACCAATATGTTTGCCACCTGGTCACCCAGCAAGGCCAGGCTGCACCTGCAGGGAAGGTCCAATGCTTGGAGG |

TABLE 9-continued

| ceDNA Vector Name | Nucleic Acid Sequence |
|---|---|
| | CCTCAGGTGAACAATCCAAAGGAGTGGCTGCAGGTGGACTTCCAGAAGACTATGAAGGTGACAGGAGTGACCACTCAGGGAGTGAAGAGCCTGCTGAC |
| | CTCCATGTATGTGAAGGAGTTTCTGATCTCCAGCTCCCAGGATGGCCACCAGTGGACCCTGTTCTTTCAGAATGGCAAGGTGAAGGTGTTTCAGGGGA |
| | ATCAGGACTCCTTCACCCCAGTGGTGAATTCCCTGGATCCCCCTCTGCTGACCAGATACCTGAGAATCCACCCCCAGTCTTGGGTGCACCAGATTGCC |
| | CTTAGGATGGAGGTGCTGGGCTGTGAGGCCCAGGACCTGTACTGATTAATTAAGAGCATCTTACCGCCATTTATTCCCATATTTGTTCTGTTTTTCTT |
| | GATTTGGGTATACATTTAAATGTTAATAAAACAAAATGGTGGGGCAATCATTTACATTTTTAGGGATATGTAATTACTAGTTCAGGTGTATTGCCACA |
| | AGACAAACATGTTAAGAAACTTTCCCGTTATTTACGCTCTGTTCCTGTTAATCAACCTCTGGATTACAAAATTTGTGAAAGATTGACTGATATTCTTA |
| | ACTATGTTGCTCCTTTTACGCTGTGTGGATATGCTGCTTTATAGCCTCTGTATCTAGCTATTGCTTCCCGTACGGCTTTCGTTTTCTCCTCCTTGTAT |
| | AAATCCTGGTTGCTGTCTCTTTTAGAGGAGTTGTGGCCCGTTGTCCGTCAACGTGGCGTGGTGTGCTCTGTGTTTGCTGACGCAACCCCCACTGGCTG |
| | GGGCATTGCCACCACCTGTCAACTCCTTTCTGGGACTTTCGCTTTCCCCCTCCCGATCGCCACGGCAGAACTCATCGCCGCCTGCCTTGCCCGCTGCT |
| | GGACAGGGGCTAGGTTGCTGGGCACTGATAATTCCGTGGTGTTGTCTGTGCCTTCTAGTTGCCAGCCATCTGTTGTTTGCCCCTCCCCCGTGCCTTCC |
| | TTGACCCTGGAAGGTGCCACTCCCACTGTCCTTTCCTAATAAAATGAGGAAATTGCATCGCATTGTCTGAGTAGGTGTCATTCTATTCTGGGGGGTGG |
| | GGTGGGGCAGGACAGCAAGGGGGAGGATTGGGAAGACAATAGCAGGCATGCTGGGGATGCGGTGGGCTCTATGGCTCTAGAGCATGGCTACGTAGATA |
| | AGTAGCATGGCGGGTTAATCATTAACTACACCTGCAGGAGGAACCCCTAGTGATGGAGTTGGCCACTCCCTCTCTGCGCGCTCGCTCGCTCACTGAGG |
| | CCGGGCGACCAAAGGTCGCCCGACGCCCGGGCGGCCTCAGTGAGCGAGCGAGCGCGCAGCTGCCTGCAGGGGCGCGCCTCGAGGCATGCGGTACCAAG |
| | CTTGTCGAGAAGTACTAGAGGATCATAATCAGCCATACCACATTTGTAGAGGTTTTACTTGCTTTAAAAAACCTCCCACACCTCCCCCTGAACCTGAA |
| | ACATAAAATGAATGCAATTGTTGTTGTTAACTTGTTTATTGCAGCTTATAATGGTTACAAATAAAGCAATAGCATCACAAATTTCACAAATAAAGCAT |
| | TTTTTTCACTGCATTCTAGTTGTGGTTTGTCCAAACTCATCAATGTATCTTATCATGTCTGGATCTGATCACTGATATCGCCTAGGAGATCCGAACCA |
| | GATAAGTGAAATCTAGTTCCAAACTATTTTGTCATTTTTAATTTTCGTATTAGCTTACGACGCTACACCCAGTTCCCATCTATTTTGTCACTCTTCCC |
| | TAAATAATCCTTAAAAACTCCATTTCCACCCCTCCCAGTTCCCAACTATTTTGTCCGCCCACAGCGGGGCATTTTTCTTCCTGTTATGTTTTTAATCA |
| | AACATCCTGCCAACTCCATGTGACAAACCGTCATCTTCGGCTACTTTTTCTCTGTCACAGAATGAAAATTTTTCTGTCATCTCTTCGTTATTAATGTT |
| | TGTAATTGACTGAATATCAACGCTTATTTGCAGCCTGAATGGCGAATGGGACGCGCCCTGTAGCGGCGCATTAAGCGCGGCGGGTGTGGTGGTTACGC |
| | GCAGCGTGACCGCTACACTTGCCAGCGCCCTAGCGCCCGCTCCTTTCGCTTTCTTCCCTTCCTTTCTCGCCACGTTCGCCGGCTTTCCCCGTCAAGCT |
| | CTAAATCGGGGGCTCCCTTTAGGGTTCCGATTTAGTGCTTTACGGCACCTCGACCCCAAAAAACTTGATTAGGGTGATGGTTCACGTAGTGGGCCATC |
| | GCCCTGATAGACGGTTTTTCGCCCTTTGACGTTGGAGTCCACGTTCTTTAATAGTGGACTCTTGTTCCAAACTGGAACAACACTCAACCCTATCTCGG |
| | TCTATTCTTTTGATTTATAAGGGATTTTGCCGATTTCGGCCTATTGGTTAAAAAATGAGCTGATTTAACAAAAATTTAACGCGAATTTTAACAAAATA |
| | TTAACGTTTACAATTTCAGGTGGCACTTTTCGGGGAAATGTGCGCGGAACCCCTATTTGTTTATTTTTCTAAATACATTCAAATATGTATCCGCTCAT |
| | GAGACAATAACCCTGATAAATGCTTCAATAATATTGAAAAAGGAAGAGTATGAGTATTCAACATTTCCGTGTCGCCCTTATTCCCTTTTTTGCGGCAT |
| | TTTGCCTTCCTGTTTTTGCTCACCCAGAAACGCTGGTGAAAGTAAAAGATGCTGAAGATCAGTTGGGTGCACGAGTGGGTTACATCGAACTGGATCTC |
| | AACAGCGGTAAGATCCTTGAGAGTTTTCGCCCCGAAGAACGTTTTCCAATGATGAGCACTTTTAAAGTTCTGCTATGTGGCGCGGTATTATCCCGTAT |
| | TGACGCCGGGCAAGAGCAACTCGGTCGCCGCATACACTATTCTCAGAATGACTTGGTTGAGTACTCACCAGTCACAGAAAAGCATCTTACGGATGGCA |
| | TGACAGTAAGAGAATTATGCAGTGCTGCCATAACCATGAGTGATAACACTGCGGCCAACTTACTTCTGACAACGATCGGAGGACCGAAGGAGCTAACC |
| | GCTTTTTTGCACAACATGGGGGATCATGTAACTCGCCTTGATCGTTGGGAACCGGAGCTGAATGAAGCCATACCAAACGACGAGCGTGACACCACGAT |
| | GCCTGTAGCAATGGCAACAACGTTGCGCAAACTATTAACTGGCGAACTACTTACTCTAGCTTCCCGGCAACAATTAATAGACTGGATGGAGGCGGATA |
| | AAGTTGCAGGACCACTTCTGCGCTCGGCCCTTCCGGCTGGCTGGTTTATTGCTGATAAATCTGGAGCCGGTGAGCGTGGGTCTCGCGGTATCATTGCA |
| | GCACTGGGGCCAGATGGTAAGCCCTCCCGTATCGTAGTTATCTACACGACGGGGAGTCAGGCAACTATGGATGAACGAAATAGACAGATCGCTGAGAT |
| | AGGTGCCTCACTGATTAAGCATTGGTAACTGTCAGACCAAGTTTACTCATATATACTTTAGATTGATTTAAAACTTCATTTTTAATTTAAAAGGATCT |
| | AGGTGAAGATCCTTTTTGATAATCTCATGACCAAAATCCCTTAACGTGAGTTTTCGTTCCACTGAGCGTCAGACCCCGTAGAAAAGATCAAAGGATCT |
| | TCTTGAGATCCTTTTTTTCTGCGCGTAATCTGCTGCTTGCAAACAAAAAAACCACCGCTACCAGCGGTGGTTTGTTTGCCGGATCAAGAGCTACCAAC |
| | TCTTTTTCCGAAGGTAACTGGCTTCAGCAGAGCGCAGATACCAAATACTGTCCTTCTAGTGTAGCCGTAGTTAGGCCACCACTTCAAGAACTCTGTAG |
| | CACCGCCTACATACCTCGCTCTGCTAATCCTGTTACCAGTGGCTGCTGCCAGTGGCGATAAGTCGTGTCTTACCGGGTTGGACTCAAGACGATAGTTA |
| | CCGGATAAGGCGCAGCGGTCGGGCTGAACGGGGGGTTCGTGCACACAGCCCAGCTTGGAGCGAACGACCTACACCGAACTGAGATACCTACAGCGTGA |
| | GCATTGAGAAAGCGCCACGCTTCCCGAAGGGAGAAAGGCGGACAGGTATCCGGTAAGCGGCAGGGTCGGAACAGGAGAGCGCACGAGGGAGCTTCCAG |
| | GGGGAAACGCCTGGTATCTTTATAGTCCTGTCGGGTTTCGCCACCTCTGACTTGAGCGTCGATTTTTGTGATGCTCGTCAGGGGGGCGGAGCCTATGG |
| | AAAAACGCCAGCAACGCGGCCTTTTTACGGTTCCTGGCCTTTTGCTGGCCTTTTGCTCACATGTTCTTTCCTGCGTTATCCCCTGATTCTGTGGATAA |
| | CCGTATTACCGCCTTTGAGTGAGCTGATACCGCTCGCCGCAGCCGAACGACCGAGCGCAGCGAGTCAGTGAGCGAGGAAGCGGAAGAGCGCCTGATGC |
| | GGTATTTTCTCCTTACGCATCTGTGCGGTATTTCACACCGCAGACCAGCCGCGTAACCTGGCAAAATCGGTTACGGTTGAGTAATAAATGGATGCCCT |
| | GCGTAAGCGGGTGTGGGCGGACAATAAAGTCTTAAACTGAACAAAATAGATCTAAACTATGACAATAAAGTCTTAAACTAGACAGAATAGTTGTAAAC |
| | TGAAATCAGTCCAGTTATGCTGTGAAAAAGCATACTGGACTTTTGTTATGGCTAAAGCAAACTCTTCATTTTCTGAAGTGCAAATTGCCCGTCGTATT |
| | AAAGAGGGGCGTGGCCAAGGGCATGGTAAAGACTATATTCGCGGCGTTGTGACAATTTACCGAACAACTCCGCGGCCGGGAAGCCGATCTCGGCTTGA |
| | ACGAATTGTTAGGTGGCGGTACTTGGGTCGATATCAAAGTGCATCACTTCTTCCCGTATGCCCAACTTTGTATAGAGAGCCACTGCGGGATCGTCACC |

TABLE 9-continued

| ceDNA Vector Name | Nucleic Acid Sequence |
|---|---|
| | GTAATCTGCTTGCACGTAGATCACATAAGCACCAAGCGCGTTGGCCTCATGCTTGAGGAGATTGATGAGCGCGGTGGCAATGCCCTGCCTCCGGTGCT<br>CGCCGGAGACTGCGAGATCATAGATATAGATCTCACTACGCGGCTGCTCAAACCTGGGCAGAACGTAAGCCGCGAGAGCGCCAACAACCGCTTCTTGG<br>TCGAAGGCAGCAAGCGCGATGAATGTCTTACTACGGAGCAAGTTCCCGAGGTAATCGGAGTCCGGCTGATGTTGGGAGTAGGTGGCTACGTCTCCGAA<br>CTCACGACCGAAAAGATCAAGAGCAGCCCGCATGGATTTGACTTGGTCAGGGCCGAGCCTACATGTGCGAATGATGCCCATACTTGAGCCACCTAACT<br>TTGTTTTAGGGCGACTGCCCTGCTGCGTAACATCGTTGCTGCTGCGTAACATCGTTGCTGCTCCATAACATCAAACATCGACCCACGGCGTAACGCGC<br>TTGCTGCTTGGATGCCCGAGGCATAGACTGTACAAAAAAACAGTCATAACAAGCCATGAAAACCGCCACTGCGCCGTTACCACCGCTGCGTTCGGTCA<br>AGGTTCTGGACCAGTTGCGTGAGCGCATACGCTACTTGCATTACAGTTTACGAACCGAACAGGCTTATGTCAACTGGGTTCGTGCCTTCATCCGTTTC<br>CACGGTGTGCGTCACCCGGCAACCTTGGGCAGCAGCGAAGTCGAGGCATTTCTGTCCTGGCTGGCGAACGAGCGCAAGGTTTCGGTCTCCACGCATCG<br>TCAGGCATTGGCGGCCTTGCTGTTCTTCTACGGCAAGGTGCTGTGCACGGATCTGCCCTGGCTTCAGGAGATCGGAAGACCTCGGCCGTCGCGGCGCT<br>TGCCGGTGGTGCTGACCCCGGATGAAGTGGTTCGCATCCTCGGTTTTCTGGAAGGCGAGCATCGTTTGTTCGCCCAGGACTCTAGCTATAGTTCTAGT<br>GGTTGGCTACGTATACTCCGGAATATTAATAGATCATGGAGATAATTAAAATGATAACCATCTCGCAAATAAATAAGTATTTTACTGTTTTCGTAACA<br>GTTTTGTAATAAAAAAACCTATAAATATTCCGGATTATTCATACCGTCCCACCATCGGGCGCGGATCTCGGTCCGAAACCATGTCGTACTACCATCAC<br>CATCACCATCACGATTACGATATCCCAACGACCGAAAACCTGTATTTTCAGGGCGCCATGGGATCC |
| ceDNAFVIII-vector 24 (SEQ ID NO: 215) | GGCCGGCCCCTGCAGGCAGCTGCGCGCTCGCTCGCTCACTGAGGCCGCCCGGGCAAAGCCCGGGCGTCGGGCGACCTTTGGTCGCCCGGCCTCAGTGA<br>GCGAGCGAGCGCGCAGAGAGGGAGTGGCCAACTCCATCACTAGGGGTTCCTTGTAGTTAATGATTAACCCGCCATGCTACTTATCTACGTAGCCATGC<br>TCTAGA**CGGGGGAGGCTGCTGGTGAATATTAACCAAGGTCACCCCAGTTATCGGAGGAGCAAACAGGGGCTAAGTCCACACGCGTGGTACCGTCTGTC**<br>**TGCACATTTCGTAGAGCGAGTGTTCCGATACTCTAATCTCCCTAGGCAAGGTTCATATTTGTGTAGGTTACTTATTCTCCTTTTGTTGACTAAGTCAA**<br>**TAATCAGAATCAGCAGGTTTGGAGTCAGCTTGGCAGGGATCAGCAGCCTGGGTTGGAAGGAGGGG**GTATAAAAGCCCCTTCACCAGGAGAAGCCGTCA<br>CACAGATCCACAAGCTCCTGAAGAGGTAAGGGTTTAAGGGATGGTTGGTTGGTGGGGTATTAATGTTTAATTACCTGGAGCACCTGCCTGAAATCACT<br>TTTTTTCAGGTTGGTTTAAACGCCGCCACCATGCAAATAGAGCTCTCCACCTGCTTCTTTCTGTGCCTTTTGCGATTCTGCTTTAGTGCCACCAGAAG<br>ATACTACCTGGGTGCAGTGGAACTGTCATGGGACTATATGCAAAGTGATCTCGGTGAGCTGCCTGTGGACGCAAGATTTCCTCCTAGAGTGCCAAAAT<br>CTTTTCCATTCAACACCTCAGTCGTGTACAAAAAGACTCTGTTTGTAGAATTCACGGATCACCTTTTCAACATCGCTAAGCCAAGGCCACCCTGGATG<br>GGTCTGCTAGGTCCTACCATCCAGGCTGAGGTTTATGATACAGTGGTCATTACACTTAAGAACATGGCTTCCCATCCTGTCAGTCTTCATGCTGTTGG<br>TGTATCCTACTGGAAAGCTTCTGAGGGAGCTGAATATGATGATCAGACCAGTCAAAGGGAGAAAGAAGATGATAAAGTCTTCCCTGGTGGAAGCCATA<br>CATATGTCTGGCAGGTCCTGAAAGAGAATGGTCCAATGGCCTCTGACCCACTGTGCCTTACCTACTCATATCTTTCTCATGTGGACCTGGTAAAAGAC<br>TTGAATTCAGGCCTCATTGGAGCCCTACTAGTATGTAGAGAAGGGAGTCTGGCCAAGGAAAAGACACAGACCTTGCACAAATTTATACTACTTTTTGC<br>TGTATTTGATGAAGGGAAAAGTTGGCACTCAGAAACAAAGAACTCCTTGATGCAGGATAGGGATGCTGCATCTGCTCGGGCCTGGCCTAAAATGCACA<br>CAGTCAATGGTTATGTAAACAGGTCTCTGCCAGGTCTGATTGGATGCCACAGGAAATCAGTCTATTGGCATGTGATTGGAATGGGCACCACTCCTGAA<br>GTGCACTCAATATTCCTCGAAGGTCACACATTTCTTGTGAGGAACCATCGCCAGGCGTCCTTGGAAATCTCGCCAATAACTTTCCTTACTGCTCAAAC<br>ACTCTTGATGGACCTTGGACAGTTTCTACTGTTTTGTCATATCTCTTCCCACCAACATGATGGCATGGAAGCTTATGTCAAAGTAGACAGCTGTCCAG<br>AGGAACCCCAACTACGAATGAAAAATAATGAAGAAGCGGAAGACTATGATGATGATCTTACTGATTCTGAAATGGATGTGGTCAGGTTTGATGATGAC<br>AACTCTCCTTCCTTTATCCAAATTCGCTCAGTTGCCAAGAAGCATCCTAAAACTTGGGTACATTACATTGCTGCTGAAGAGGAGGACTGGGACTATGC<br>TCCCTTAGTCCTCGCCCCCGATGACAGAAGTTATAAAAGTCAATATTTGAACAATGGCCCTCAGCGGATTGGTAGGAAGTACAAAAAAGTCCGATTTA<br>TGGCATACACAGATGAAACCTTTAAGACTCGTGAAGCTATTCAGCATGAATCAGGAATCTTGGGACCTTTACTTTATGGGGAAGTTGGAGACACACTG<br>TTGATTATATTTAAGAATCAAGCAAGCAGACCATATAACATCTACCCTCACGGAATCACTGATGTCCGTCCTTTGTATTCAAGGAGATTACCAAAAGG<br>TGTAAAACATTTGAAGGATTTTCCAATTCTGCCAGGAGAAATATTCAAATATAAATGGACAGTGACTGTAGAAGATGGGCCAACTAAATCAGATCCTC<br>GGTGCCTGACCCGCTATTACTCTAGTTTCGTTAATATGGAGAGAGATCTAGCTTCAGGACTCATTGGCCCTCTCCTCATCTGCTACAAAGAATCTGTA<br>GATCAAAGAGGAAACCAGATAATGTCAGACAAGAGGAATGTCATCCTGTTTTCTGTATTTGATGAGAACCGAAGCTGGTACCTCACAGAGAATATACA<br>ACGCTTTCTCCCCAATCCAGCTGGAGTGCAGCTTGAGGATCCAGAGTTCCAAGCCTCCAACATCATGCACAGCATCAATGGCTATGTTTTTGATAGTT<br>TGCAGTTGTCAGTTTGTTTGCATGAGGTGGCATACTGGTACATTCTAAGCATTGGAGCACAGACTGACTTCCTTTCTGTCTTCTTCTCTGGATATACC<br>TTCAAACACAAAATGGTCTATGAAGACACACTCACCCTATTCCCATTCTCAGGAGAAACTGTCTTCATGTCGATGGAAAACCCAGGTCTATGGATTCT<br>GGGGTGCCACAACTCAGACTTTCGGAACAGAGGCATGACCGCCTTACTGAAGGTTTCTAGTTGTGACAAGAACACTGGTGATTATTACGAGGACAGTT<br>ATGAAGATATTTCAGCATACTTGCTGAGTAAAAACAATGCCATTGAACCAAGAAGCTTCTCCCAGAATTCAAGACACCCTAGCACTAGGCAAAAGCAA<br>TTTAATGCCACCACAATTCCAGAAAATGACATAGAGAAGACTGACCCTTGGTTTGCACACAGAACACCTATGCCTAAAATACAAAATGTCTCCTCTAG<br>TGATTTGTTGATGCTCTTGCGACAGAGTCCTACTCCACATGGGCTATCCTTATCTGATCTCCAAGAAGCCAAATATGAGACTTTTTCTGATGATCCAT<br>CACCTGGAGCAATAGACAGTAATAACAGCCTGTCTGAAATGACACACTTCAGGCCACAGCTCCATCACAGTGGGGACATGGTATTTACCCCTGAGTCA<br>GGCCTCCAATTAAGATTAAATGAGAAACTGGGGACAACTGCAGCAACAGAGTTGAAGAAACTTGATTTCAAAGTTTCTAGTACATCAAATAATCTGAT<br>TTCAACAATTCCATCAGACAATTTGGCAGCAGGTACTGATAATACAAGTTCCTTAGGACCCCCAAGTATGCCAGTTCATTATGATAGTCAATTAGATA<br>CCACTCTATTTGGCAAAAAGTCATCTCCCCTTACTGAGTCTGGTGGACCTCTGAGCTTGAGTGAAGAAAATAATGATTCAAAGTTGTTAGAATCAGGT |

TABLE 9-continued

| ceDNA Vector Name | Nucleic Acid Sequence |
| --- | --- |
| | TTAATGAATAGCCAAGAAAGTTCATGGGGAAAAAATGTATCGTCAACAGAGAGTGGTAGGTTATTTAAAGGGAAAAGAGCTCATGGACCTGCTTTGTT |
| | GACTAAAGATAATGCCTTATTCAAAGTTAGCATCTCTTTGTTAAAGACAAACAAAACTTCCAATAATTCAGCAACTAATAGAAAGACTCACATTGATG |
| | GCCCATCATTATTAATTGAGAATAGTCCATCAGTCTGGCAAAATATATTAGAAAGTGACACTGAGTTTAAAAAAGTGACACCTTTGATTCATGACAGA |
| | ATGCTTATGGACAAAAATGCTACAGCTTTGAGGCTAAATCATATGTCAAATAAAACTACTTCATCAAAAAACATGGAAATGGTCCAACAGAAAAAAGA |
| | GGGCCCCATTCCACCAGATGCACAAAATCCAGATATGTCGTTCTTTAAGATGCTATTCTTGCCAGAATCAGCAAGGTGGATACAAAGGACTCATGGAA |
| | AGAACTCTCTGAACTCTGGGCAAGGCCCCAGTCCAAAGCAATTAGTATCCTTAGGACCAGAAAAATCTGTGGAAGGTCAGAATTTCTTGTCTGAGAAA |
| | AACAAAGTGGTAGTAGGAAAGGGTGAATTTACAAAGGACGTAGGACTCAAAGAGATGGTTTTTCCAAGCAGCAGAAACCTATTTCTTACTAACTTGGA |
| | TAATTTACATGAAAATAATACACACAATCAAGAAAAAAAAATTCAGGAAGAAATAGAAAAGAAGGAAACATTAATCCAAGAGAATGTAGTTTTGCCTC |
| | AGATACATACAGTGACTGGCACTAAGAATTTCATGAAGAACCTTTTCTTACTGAGCACTAGGCAAAATGTAGAAGGTTCATATGACGGGGCATATGCT |
| | CCAGTACTTCAAGATTTTAGGTCATTAAATGATTCAACAAATAGAACAAAGAAACACACAGCTCATTTCTCAAAAAAAGGGGAGGAAGAAAACTTGGA |
| | AGGCTTGGGAAATCAAACCAAGCAAATTGTAGAGAAATATGCATGCACCACAAGGATATCTCCTAATACAAGCCAGCAGAATTTTGTCACGCAACGTA |
| | GTAAGAGAGCTTTGAAACAATTCAGACTCCCACTAGAAGAAACAGAACTTGAAAAAAGGATAATTGTGGATGACACCTCAACCCAGTGGTCCAAAAAC |
| | ATGAAACATTTGACCCCGAGCACCCTCACACAGATAGACTACAATGAGAAGGAGAAAGGGGCCATTACTCAGTCTCCCTTATCAGATTGCCTTACGAG |
| | GAGTCATAGCATCCCTCAAGCAAATAGATCTCCATTACCCATTGCAAAGGTATCATCATTTCCATCTATTAGACCTATATATCTGACCAGGGTCCTAT |
| | TCCAAGACAACTCTTCTCATCTTCCAGCAGCATCTTATAGAAAGAAAGATTCTGGGGTCCAAGAAAGCAGTCATTTCTTACAAGGAGCCAAAAAAAAT |
| | AACCTTTCTTTAGCCATTCTAACCTTGGAGATGACTGGTGATCAAAGAGAGGTTGGCTCCCTGGGGACAAGTGCCACAAATTCAGTCACATACAAGAA |
| | AGTTGAGAACACTGTTCTCCCGAAACCAGACTTGCCCAAAACATCTGGCAAAGTTGAATTGCTTCCAAAAGTTCACATTTATCAGAAGGACCTATTCC |
| | CTACGGAAACTAGCAATGGGTCTCCTGGCCATCTGGATCTCGTGGAAGGGAGCCTTCTTCAGGGAACAGAGGGAGCGATTAAGTGGAATGAAGCAAAC |
| | AGACCTGGAAAAGTTCCCTTTCTGAGAGTAGCAACAGAAAGCTCTGCAAAGACTCCCTCCAAGCTATTGGATCCTCTTGCTTGGGATAACCACTATGG |
| | TACTCAGATACCAAAAGAAGAGTGGAAATCCCAAGAGAAGTCACCAGAAAAAACAGCTTTTAAGAAAAAGGATACCATTTTGTCCCTGAACGCTTGTG |
| | AAAGCAATCATGCAATAGCAGCAATAAATGAGGGACAAAATAAGCCCGAAATAGAAGTCACCTGGGCAAAGCAAGGTAGGACTGAAAGGCTGTGCTCT |
| | CAAAACCCACCAGTCTTGAAACGCCATCAACGGGAAATAACTCGTACTACTCTTCAGTCAGATCAAGAGGAAATTGACTATGATGATACCATATCAGT |
| | TGAAATGAAGAAGGAAGATTTTGACATTTATGATGAGGATGAAAATCAGAGCCCCCGCAGCTTTCAAAAGAAAACACGACACTATTTTATTGCTGCAG |
| | TGGAGAGGCTCTGGGATTATGGGATGAGTAGCTCCCCACATGTTCTAAGAAACAGGGCTCAGAGTGGCAGTGTCCCTCAGTTCAAGAAAGTTGTTTTC |
| | CAGGAATTTACTGATGGCTCCTTTACTCAGCCCTTATACCGTGGAGAACTAAATGAACATTTGGGACTCCTGGGGCCATATATAAGAGCAGAAGTTGA |
| | AGATAATATCATGGTAACTTTCAGAAATCAGGCCTCTCGTCCCTATTCCTTCTATTCTAGCCTTATTTCTTATGAGGAAGATCAGAGGCAAGGAGCAG |
| | AACCTAGAAAAAACTTTGTCAAGCCTAATGAAACCAAAACTTACTTTTGGAAAGTGCAACATCATATGGCACCCACTAAAGATGAGTTTGACTGCAAA |
| | GCCTGGGCTTATTTCTCTGATGTTGACCTGGAAAAAGATGTGCACTCAGGCCTGATTGGACCCCTTCTGGTCTGCCACACTAACACACTGAACCCTGC |
| | TCATGGGAGACAAGTGACAGTACAGGAATTTGCTCTGTTTTTCACCATCTTTGATGAGACCAAAAGCTGGTACTTCACTGAAAATATGGAAAGAAACT |
| | GCAGGGCTCCCTGCAATATCCAGATGGAAGATCCCACTTTTAAAGAGAATTATCGCTTCCATGCAATCAATGGCTACATAATGGATACACTACCTGGC |
| | TTAGTAATGGCTCAGGATCAAAGGATTCGATGGTATCTGCTCAGCATGGGCAGCAATGAAAACATCCATTCTATTCATTTCAGTGGACATGTGTTCAC |
| | TGTACGAAAAAAAGAGGAGTATAAAATGGCACTGTACAATCTCTATCCAGGTGTTTTTGAGACAGTGGAAATGTTACCATCCAAAGCTGGAATTTGGC |
| | GGGTGGAATGCCTTATTGGCGAGCATCTACATGCTGGGATGAGCACACTTTTTCTGGTGTACAGCAATAAGTGTCAGACTCCCCTGGGAATGGCTTCT |
| | GGACACATTAGAGATTTTCAGATTACAGCTTCAGGACAATATGGACAGTGGGCCCCAAAGCTGGCCAGACTTCATTATTCCGGATCAATCAATGCCTG |
| | GAGCACCAAGGAGCCCTTTTCTTGGATCAAGGTGGATCTGTTGGCACCAATGATTATTCACGGCATCAAGACCCAGGGTGCCCGTCAGAAGTTCTCCA |
| | GCCTCTACATCTCTCAGTTTATCATCATGTATAGTCTTGATGGGAAGAAGTGGCAGACTTATCGAGGAAATTCCACTGGAACCTTAATGGTCTTCTTT |
| | GGCAATGTGGATTCATCTGGGATAAAACACAATATTTTTAACCCTCCAATTATTGCTCGATACATCCGTTTGCACCCAACTCATTATAGCATTCGCAG |
| | CACTCTTCGCATGGAGTTGATGGGCTGTGATTTAAATAGTTGCAGCATGCCATTGGGAATGGAGAGTAAAGCAATATCAGATGCACAGATTACTGCTT |
| | CATCCTACTTTACCAATATGTTTGCCACCTGGTCTCCTTCAAAAGCTCGACTTCACCTCCAAGGGAGGAGTAATGCCTGGAGACCTCAGGTGAATAAT |
| | CCAAAAGAGTGGCTGCAAGTGGACTTCCAGAAGACAATGAAAGTCACAGGAGTAACTACTCAGGGAGTAAAATCTCTGCTTACCAGCATGTATGTGAA |
| | GGAGTTCCTCATCTCCAGCAGTCAAGATGGCCATCAGTGGACTCTCTTTTTTCAGAATGGCAAAGTAAAGGTTTTTCAGGGAAATCAAGACTCCTTCA |
| | CACCTGTGGTGAACTCTCTAGACCCACCGTTACTGACTCGCTACCTTCGAATTCACCCCCAGAGTTGGGTGCACCAGATTGCCCTGAGGATGGAGGTT |
| | CTGGGCTGCGAGGCACAGGACCTCTACTGATTAATTAAGAGCATCTTACCGCCATTTATTCCCATATTTGTTCTGTTTTTCTTGATTTGGGTATACAT |
| | TTAAATGTTAATAAAACAAAATGGTGGGGCAATCATTTACATTTTTAGGGATATGTAATTACTAGTTCAGGTGTATTGCCACAAGACAAACATGTTAA |
| | GAAACTTTCCCGTTATTTACGCTCTGTTCCTGTTAATCAACCTCTGGATTACAAAATTTGTGAAAGATTGACTGATATTCTTAACTATGTTGCTCCTT |
| | TTACGCTGTGTGGATATGCTGCTTTATAGCCTCTGTATCTAGCTATTGCTTCCCGTACGGCTTTCGTTTTCTCCTCCTTGTATAAATCCTGGTTGCTG |
| | TCTCTTTTAGAGGAGTTGTGGCCCGTTGTCCGTCAACGTGGCGTGGTGTGCTCTGTGTTTGCTGACGCAACCCCCACTGGCTGGGGCATTGCCACCAC |
| | CTGTCAACTCCTTTCTGGGACTTTCGCTTTCCCCCTCCCGATCGCCACGGCAGAACTCATCGCCGCCTGCCTTGCCCGCTGCTGGACAGGGGCTAGGT |
| | TGCTGGGCACTGATAATTCCGTGGTGTTGTCTGTGCCTTCTAGTTGCCAGCCATCTGTTGTTTGCCCCTCCCCCGTGCCTTCCTTGACCCTGGAAGGT |
| | GCCACTCCCACTGTCCTTTCCTAATAAAATGAGGAAATTGCATCGCATTGTCTGAGTAGGTGTCATTCTATTCTGGGGGGTGGGGTGGGGCAGGACAG |

TABLE 9-continued

| ceDNA Vector Name | Nucleic Acid Sequence |
|---|---|
| | CAAGGGGGAGGATTGGGAAGACAATAGCAGGCATGCTGGGGATGCGGTGGGCTCTATGGCTCTAGAGCATGGCTACGTAGATAAGTAGCATGGCGGGT<br>TAATCATTAACTACACCTGCAGGAGGAACCCCTAGTGATGGAGTTGGCCACTCCCTCTCTGCGCGCTCGCTCGCTCACTGAGGCCGGGCGACCAAAGG<br>TCGCCCGACGCCCGGGCGGCCTCAGTGAGCGAGCGAGCGCGCAGCTGCCTGCAGGGGCGCGCCTCGAGGCATGCGGTACCAAGCTTGTCGAGAAGTAC<br>TAGAGGATCATAATCAGCCATACCACATTTGTAGAGGTTTTACTTGCTTTAAAAAACCTCCCACACCTCCCCCTGAACCTGAAACATAAAATGAATGC<br>AATTGTTGTTGTTAACTTGTTTATTGCAGCTTATAATGGTTACAAATAAAGCAATAGCATCACAAATTTCACAAATAAAGCATTTTTTTCACTGCATT<br>CTAGTTGTGGTTTGTCCAAACTCATCAATGTATCTTATCATGTCTGGATCTGATCACTGATATCGCCTAGGAGATCCGAACCAGATAAGTGAAATCTA<br>GTTCCAAACTATTTTGTCATTTTTAATTTTCGTATTAGCTTACGACGCTACACCCAGTTCCCATCTATTTTGTCACTCTTCCCTAAATAATCCTTAAA<br>AACTCCATTTCCACCCCTCCCAGTTCCCAACTATTTTGTCCGCCCACAGCGGGGCATTTTTCTTCCTGTTATGTTTTTAATCAAACATCCTGCCAACT<br>CCATGTGACAAACCGTCATCTTCGGCTACTTTTTCTCTGTCACAGAATGAAAATTTTTCTGTCATCTCTTCGTTATTAATGTTTGTAATTGACTGAAT<br>ATCAACGCTTATTTGCAGCCTGAATGGCGAATGGACGCGCCCTGTAGCGGCGCATTAAGCGCGGCGGGTGTGGTGGTTACGCGCAGCGTGACCGCTA<br>CACTTGCCAGCGCCCTAGCGCCCGCTCCTTTCGCTTTCTTCCCTTCCTTTCTCGCCACGTTCGCCGGCTTTCCCCGTCAAGCTCTAAATCGGGGGCTC<br>CCTTTAGGGTTCCGATTTAGTGCTTTACGGCACCTCGACCCCAAAAAACTTGATTAGGGTGATGGTTCACGTAGTGGGCCATCGCCCTGATAGACGGT<br>TTTTCGCCCTTTGACGTTGGAGTCCACGTTCTTTAATAGTGGACTCTTGTTCCAAACTGGAACAACACTCAACCCTATCTCGGTCTATTCTTTTGATT<br>TATAAGGGATTTTGCCGATTTCGGCCTATTGGTTAAAAAATGAGCTGATTTAACAAAAATTTAACGCGAATTTTAACAAAATATTAACGTTTACAATT<br>TCAGGTGGCACTTTTCGGGGAAATGTGCGCGGAACCCCTATTTGTTTATTTTTCTAAATACATTCAAATATGTATCCGCTCATGAGACAATAACCCTG<br>ATAAATGCTTCAATAATATTGAAAAAGGAAGAGTATGAGTATTCAACATTTCCGTGTCGCCCTTATTCCCTTTTTTGCGGCATTTTGCCTTCCTGTTT<br>TTGCTCACCCAGAAACGCTGGTGAAAGTAAAAGATGCTGAAGATCAGTTGGGTGCACGAGTGGGTTACATCGAACTGGATCTCAACAGCGGTAAGATC<br>CTTGAGAGTTTTCGCCCCGAAGAACGTTTTCCAATGATGAGCACTTTTAAAGTTCTGCTATGTGGCGCGGTATTATCCCGTATTGACGCCGGGCAAGA<br>GCAACTCGGTCGCCGCATACACTATTCTCAGAATGACTTGGTTGAGTACTCACCAGTCACAGAAAAGCATCTTACGGATGGCATGACAGTAAGAGAAT<br>TATGCAGTGCTGCCATAACCATGAGTGATAACACTGCGGCCAACTTACTTCTGACAACGATCGGAGGACCGAAGGAGCTAACCGCTTTTTTGCACAAC<br>ATGGGGGATCATGTAACTCGCCTTGATCGTTGGGAACCGGAGCTGAATGAAGCCATACCAAACGACGAGCGTGACACCACGATGCCTGTAGCAATGGC<br>AACAACGTTGCGCAAACTATTAACTGGCGAACTACTTACTCTAGCTTCCCGGCAACAATTAATAGACTGGATGGAGGCGGATAAAGTTGCAGGACCAC<br>TTCTGCGCTCGGCCCTTCCGGCTGGCTGGTTTATTGCTGATAAATCTGGAGCCGGTGAGCGTGGGTCTCGCGGTATCATTGCAGCACTGGGGCCAGAT<br>GGTAAGCCCTCCCGTATCGTAGTTATCTACACGACGGGGAGTCAGGCAACTATGGATGAACGAAATAGACAGATCGCTGAGATAGGTGCCTCACTGAT<br>TAAGCATTGGTAACTGTCAGACCAAGTTTACTCATATATACTTTAGATTGATTTAAAACTTCATTTTTAATTTAAAAGGATCTAGGTGAAGATCCTTT<br>TTGATAATCTCATGACCAAAATCCCTTAACGTGAGTTTTCGTTCCACTGAGCGTCAGACCCCGTAGAAAAGATCAAAGGATCTTCTTGAGATCCTTTT<br>TTTCTGCGCGTAATCTGCTGCTTGCAAACAAAAAAACCACCGCTACCAGCGGTGGTTTGTTTGCCGGATCAAGAGCTACCAACTCTTTTTCCGAAGGT<br>AACTGGCTTCAGCAGAGCGCAGATACCAAATACTGTCCTTCTAGTGTAGCCGTAGTTAGGCCACCACTTCAAGAACTCTGTAGCACCGCCTACATACC<br>TCGCTCTGCTAATCCTGTTACCAGTGGCTGCTGCCAGTGGCGATAAGTCGTGTCTTACCGGGTTGGACTCAAGACGATAGTTACCGGATAAGGCGCAG<br>CGGTCGGGCTGAACGGGGGGTTCGTGCACACAGCCCAGCTTGGAGCGAACGACCTACACCGAACTGAGATACCTACAGCGTGAGCATTGAGAAAGCGC<br>CACGCTTCCCGAAGGGAGAAAGGCGGACAGGTATCCGGTAAGCGGCAGGGTCGGAACAGGAGAGCGCACGAGGGAGCTTCCAGGGGGAAACGCCTGGT<br>ATCTTTATAGTCCTGTCGGGTTTCGCCACCTCTGACTTGAGCGTCGATTTTTGTGATGCTCGTCAGGGGGGCGGAGCCTATGGAAAAACGCCAGCAAC<br>GCGGCCTTTTTACGGTTCCTGGCCTTTTGCTGGCCTTTTGCTCACATGTTCTTTCCTGCGTTATCCCCTGATTCTGTGGATAACCGTATTACCGCCTT<br>TGAGTGAGCTGATACCGCTCGCCGCAGCCGAACGACCGAGCGCAGCGAGTCAGTGAGCGAGGAAGCGGAAGAGCGCCTGATGCGGTATTTTCTCCTTA<br>CGCATCTGTGCGGTATTTCACACCGCAGACCAGCCGCGTAACCTGGCAAAATCGGTTACGGTTGAGTAATAAATGGATGCCCTGCGTAAGCGGGTGTG<br>GGCGGACAATAAAGTCTTAAACTGAACAAAATAGATCTAAACTATGACAATAAAGTCTTAAACTAGACAGAATAGTTGTAAACTGAAATCAGTCCAGT<br>TATGCTGTGAAAAAGCATACTGGACTTTTGTTATGGCTAAAGCAAACTCTTCATTTTCTGAAGTGCAAATTGCCCGTCGTATTAAAGAGGGGCGTGGC<br>CAAGGGCATGGTAAAGACTATATTCGCGGCGTTGTGACAATTTACCGAACAACTCCGCGGCCGGGAAGCCGATCTCGGCTTGAACGAATTGTTAGGTG<br>GCGGTACTTGGGTCGATATCAAAGTGCATCACTTCTTCCCGTATGCCCAACTTTGTATAGAGAGCCACTGCGGGATCGTCACCGTAATCTGCTTGCAC<br>GTAGATCACATAAGCACCAAGCGCGTTGGCCTCATGCTTGAGGAGATTGATGAGCGCGGTGGCAATGCCCTGCCTCCGGTGCTCGCCGGAGACTGCGA<br>GATCATAGATATAGATCTCACTACGCGGCTGCTCAAACCTGGGCAGAACGTAAGCCGCGAGAGCGCCAACAACCGCTTCTTGGTCGAAGGCAGCAAGC<br>GCGATGAATGTCTTACTACGGAGCAAGTTCCCGAGGTAATCGGAGTCCGGCTGATGTTGGGAGTAGGTGGCTACGTCTCCGAACTCACGACCGAAAAG<br>ATCAAGAGCAGCCCGCATGGATTTGACTTGGTCAGGGCCGAGCCTACATGTGCGAATGATGCCCATACTTGAGCCACCTAACTTTGTTTTAGGGCGAC<br>TGCCCTGCTGCGTAACATCGTTGCTGCTGCGTAACATCGTTGCTGCTCCATAACATCAAACATCGACCCACGGCGTAACGCGCTTGCTGCTTGGATGC<br>CCGAGGCATAGACTGTACAAAAAAACAGTCATAACAAGCCATGAAAACCGCCACTGCGCCGTTACCACCGCTGCGTTCGGTCAAGGTTCTGGACCAGT<br>TGCGTGAGCGCATACGCTACTTGCATTACAGTTTACGAACCGAACAGGCTTATGTCAACTGGGTTCGTGCCTTCATCCGTTTCCACGGTGTGCGTCAC<br>CCGGCAACCTTGGGCAGCAGCGAAGTCGAGGCATTTCTGTCCTGGCTGGCGAACGAGCGCAAGGTTTCGGTCTCCACGCATCGTCAGGCATTGGCGGC<br>CTTGCTGTTCTTCTACGGCAAGGTGCTGTGCACGGATCTGCCCTGGCTTCAGGAGATCGGAAGACCTCGGCCGTCGCGGCGCTTGCCGGTGGTGCTGA<br>CCCCGGATGAAGTGGTTCGCATCCTCGGTTTTCTGGAAGGCGAGCATCGTTTGTTCGCCCAGGACTCTAGCTATAGTTCTAGTGGTTGGCTACGTATA<br>CTCCGGAATATTAATAGATCATGGAGATAATTAAAATGATAACCATCTCGCAAATAAATAAGTATTTTACTGTTTTCGTAACAGTTTTGTAATAAAAA |

TABLE 9-continued

| ceDNA Vector Name | Nucleic Acid Sequence |
|---|---|
| | AACCTATAAATATTCCGGATTATTCATACCGTCCCACCATCGGGCGCGGATCTCGGTCCGAAACCATGTCGTACTACCATCACCATCACCATCACGAT<br>TACGATATCCCAACGACCGAAAACCTGTATTTTCAGGGCGCCATGGGATCC |
| ceDNAFVIII-vector 25 (SEQ ID NO: 216) | AAAGTAGCCGAAGATGACGGTTTGTCACATGGAGTTGGCAGGATGTTTGATTAAAAACATAACAGGAAGAAAAATGCCCCGCTGTGGGCGGACAAAAT<br>AGTTGGGAACTGGGAGGGGTGGAAATGGAGTTTTTAAGGATTATTTAGGGAAGAGTGACAAAATAGATGGGAACTGGGTGTAGCGTCGTAAGCTAATA<br>CGAAAATTAAAAATGACAAAATAGTTTGGAACTAGATTTCACTTATCTGGTTCGGATCTCCTAGGCTCAAGCAGTGATCAGATCCAGACATGATAAGA<br>TACATTGATGAGTTTGGACAAACCACAACTAGAATGCAGTGAAAAAAATGCTTTATTTGTGAAATTTGTGATGCTATTGCTTTATTTGTAACCATTAT<br>AAGCTGCAATAAACAAGTTAACAACAACAATTGCATTCATTTTATGTTTCAGGTTCAGGGGGAGGTGTGGGAGGTTTTTTAAAGCAAGTAAAACCTCT<br>ACAAATGTGGTATGGCTGATTATGATCCTCTAGTACTTCTCGACAAGCTTGTCGAGACTGCAGGCTCTAGAGGCCGGCCCCTGCAGGCAGCTGCGCGC<br>TCGCTCGCTCACTGAGGCCGCCCGGGCAAAGCCCGGGCGTCGGGCGACCTTTGGTCGCCCGGCCTCAGTGAGCGAGCGAGCGCGCAGAGAGGGAGTGG<br>CCAACTCCATCACTAGGGGTTCCTTGTAGTTAATGATTAACCCGCCATGCTACTTATCTACGTAGCCATGCATATG**GAGTCAATGGGAAAAACCCATT**<br>**GGAGCCAAGTACACTGACTCAATAGGGACTTTCCATTGGGTTTTGCCCAGTACATAAGGTCAATAGGGGGTGAGTCAACAGGAAAGTCCCATTGGAGC**<br>**CAAGTACATTGAGTCAATAGGGACTTTCCAATGGGTTTTGCCCAGTACATAAGGTCAATGGGAGGTAAGCCAATGGGTTTTTCCCATTACTGACATGT**<br>**ATACTGAGTCATTAGGGACTTTCCAATGGGTTTTGCC**CAGTACATAAGGTCAATAGGGGTGAATCAACAGGAAAGTCCCATTGGAGCCAAGTACACTG<br>AGTCAATAGGGACTTTCCATTGGGTTTTGCCCAGTACAAAAGGTCAATAGGGGGTGAGTCAATGGGTTTTTCCCATTATTGGCACATACATAAGGTCA<br>ATAGGGGTGACTAGTGGAGAAGAGCATGCTTGAGGGCTGAGTGCCCCTCAGTGGGCAGAGAGCACATGGCCCACAGTCCCTGAGAAGTTGGGGGGAGG<br>GGTGGGCAATTGAACTGGTGCCTAGAGAAGGTGGGGCTTGGGTAAACTGGGAAAGTGATGTGGTGTACTGGCTCCACCTTTTTCCCCAGGGTGGGGGA<br>GAACCATATATAAGTGCAGTAGTCTCTGTGAACATTCAAGCTTCTGCCTTCTCCCTCCTGTGAGTTTGGTAAGTCACTGACTGTCTATGCCTGGGAAA<br>GGGTGGGCAGGAGATGGGGCAGTGCAGGAAAAGTGGCACTATGAACCCTGCAGCCCTAGACAATTGTACTAACCTTCTTCTCTTTCCTCTCCTGACAG<br>GTTGGTGTACAGTAGCTTCCGTTTAAACAGCCACCATGCAGATAGAATTATCTACTTGTTTTTTTCTTTGTCTGCTCAGGTTCTGCTTCTCTGCTACA<br>AGGAGGTATTACTTAGGTGCTGTAGAGTTATCTTGGGACTACATGCAGTCTGATCTTGGGGAGCTCCCTGTGGATGCAAGATTTCCCCCTAGAGTACC<br>TAAAAGTTTCCCTTTCAACACAAGTGTGGTGTATAAGAAGACTCTGTTTGTTGAGTTCACAGATCACCTTTTCAATATTGCCAAGCCCAGACCCCCCT<br>GGATGGGTCTACTGGGGCCAACAATTCAAGCAGAGGTATATGATACAGTGGTGATCACATTAAAGAACATGGCATCCCACCCTGTAAGCCTGCATGCT<br>GTTGGTGTGTCCTATTGGAAAGCAAGTGAAGGTGCTGAATATGATGATCAAACATCCCAAAGAGAGAAGGAAGATGACAAAGTCTTCCCAGGTGGCTC<br>TCACACCTATGTGTGGCAAGTGCTCAAGGAAAATGGGCCTATGGCTAGTGATCCATTGTGCCTCACATATAGCTACCTGTCCCATGTGGACTTAGTTA<br>AAGATCTGAACTCAGGTCTGATTGGTGCCCTGCTGGTCTGTAGGGAAGGATCACTAGCTAAAGAAAAAACCCAGACTTTACACAAGTTCATCTTATTA<br>TTTGCTGTTTTGATGAGGGAAAGAGCTGGCACTCAGAGACTAAGAATTCACTCATGCAGGATAGAGATGCAGCTTCTGCTAGAGCATGGCCAAAAAT<br>GCATACTGTGAATGGGTATGTTAACAGGAGTCTGCCTGGCCTCATAGGCTGCCATAGAAAATCAGTGTACTGGCATGTCATAGGTATGGGCACTACTC<br>CTGAGGTGCATTCCATTTTTTTGGAGGGGCATACTTTCCTTGTAAGAAACCACAGGCAGGCTTCATTGGAAATTAGTCCAATAACCTTTCTCACAGCC<br>CAGACTCTGCTAATGGACTTGGGGCAGTTTTTATTATTTTGTCACATTAGCTCTCATCAGCATGATGGAATGGAAGCCTATGTTAAGGTTGATTCCTG<br>CCCAGAAGAGCCCCAGTTGAGAATGAAGAACAATGAGGAAGCAGAAGACTATGATGATGATCTAACAGACTCAGAAATGGATGTTGTGAGATTTGATG<br>ATGATAACTCCCCAAGTTTTATTCAGATCAGGTCAGTGGCCAAGAAACATCCAAAAACATGGGTTCATTATATTGCAGCAGAAGAAGAAGACTGGGAT<br>TATGCACCCTTGGTATTAGCCCCTGATGACAGAAGCTATAAGTCACAATATCTCAACAATGGACCCCAGAGAATTGGCAGAAAGTACAAAAAAGTCAG<br>GTTTATGGCTTATACTGATGAGACTTTCAAAACTAGAGAGGCTATTCAACATGAATCTGGCATCCTAGGTCCTTTGTTATATGGGGAAGTAGGGGACA<br>CCTTATTAATTATATTTAAAAACCAGGCCAGTAGGCCTTACAACATTTACCCCCACGGTATAACAGATGTCAGACCACTGTACTCAAGGAGGCTACCA<br>AAAGGGGTGAAGCACCTAAAAGACTTCCCCATCCTACCTGGTGAGATTTTCAAGTATAAGTGGACAGTGACTGTAGAAGATGGTCCAACCAAATCAGA<br>TCCCAGATGCCTGACAAGGTACTACAGTAGCTTTGTAAATATGGAGAGAGACCTGGCCTCAGGGTTAATAGGGCCCCTACTGATCTGCTACAAGGAGA<br>GTGTAGACCAAAGAGGCAACCAAATTATGTCAGACAAGAGAAATGTCATCCTCTTTAGTGTTTTTGATGAGAATAGGTCCTGGTACCTGACAGAAAAT<br>ATCCAAAGATTCCTTCCAAATCCAGCAGGGGTACAACTGGAGGACCCTGAGTTCCAGGCCTCCAATATCATGCACAGCATCAATGGTTATGTGTTTGA<br>CAGTTTGCAACTTTCAGTGTGCCTTCATGAGGTTGCATACTGGTATATACTTTCTATAGGGGCCCAGACAGACTTCTTGTCAGTTTTCTTTTCAGGCT<br>ATACTTTCAAGCATAAGATGGTATATGAAGATACCCTGACTCTTTTTCCCTTTAGTGGTGAGACAGTTTTCATGTCAATGGAAAACCCAGGGCTTTGG<br>ATCTTGGGATGCCACAACTCTGACTTTAGAAACAGAGGCATGACTGCCCTTTTAAAGGTGTCCTCTTGTGATAAGAATACTGGAGACTACTATGAGGA<br>CAGCTATGAGGACATTTCAGCCTATCTGCTGTCAAAAAATAATGCTATAGAGCCAAGGTCATTTTCTCAAAATCCTCCTGTCCTGAAGAGGCACCAAA<br>GAGAGATAACCAGGACTACCTTACAGTCTGACCAGGAGGAAATTGATTATGATGACACAATAAGTGTGGAGATGAAAAAGGAGGATTTTGATATTTAT<br>GATGAGGATGAAAACCAATCTCCAAGATCTTTCCAGAAGAAGACTAGACACTATTTCATTGCTGCAGTGGAAAGACTGTGGGACTATGGAATGTCCTC<br>CAGCCCTCATGTTCTCAGGAATAGGGCTCAAAGTGGTTCTGTGCCACAGTTCAAGAAGGTGGTGTTTCAGGAATTCACAGATGGGTCCTTTACTCAAC<br>CACTGTATAGGGGAGAACTCAATGAACATCTAGGATTACTAGGTCCCTACATTAGAGCTGAGGTGGAGGACAATATCATGGTCACTTTCAGGAACCAG<br>GCATCTAGACCATACTCTTTTTACAGCTCCTTGATATCTTATGAAGAGGACCAGAGACAGGGTGCAGAACCCAGGAAGAACTTTGTGAAACCCAATGA<br>GACCAAAACATACTTCTGGAAGGTCCAGCATCATATGGCTCCTACCAAGGATGAATTTGACTGCAAAGCCTGGGCTTACTTCTCAGATGTGGATTTGG<br>AGAAAGATGTGCACAGTGGCTTGATTGGGCCTCTTTTGGTATGTCATACCAACACCTTAAACCCTGCTCATGGAAGACAAGTAACAGTGCAAGAGTTT |

TABLE 9-continued

| ceDNA Vector Name | Nucleic Acid Sequence |
|---|---|
| | GCCCTCTTTTTCACTATATTTGATGAGACAAAAAGTTGGTACTTTACTGAGAATATGGAGAGGAACTGCAGGGCTCCCTGCAATATACAGATGGAGGA |
| | TCCTACTTTCAAGGAAAACTATAGGTTTCATGCCATTAATGGCTATATCATGGATACATTGCCTGGCTTAGTTATGGCCCAGGATCAGAGAATCAGAT |
| | GGTACCTCCTTAGTATGGGAAGCAATGAAAACATACATTCTATTCACTTCAGTGGACATGTCTTTACTGTGAGAAAAAAGGAAGAGTACAAGATGGCA |
| | CTGTACAATCTGTACCCTGGAGTGTTTGAGACAGTTGAGATGCTGCCCAGCAAGGCTGGGATCTGGAGGGTAGAATGCCTGATTGGAGAACACTTACA |
| | TGCAGGTATGTCCACTCTATTCTTGGTCTATTCCAACAAGTGTCAGACCCCCCTAGGCATGGCATCTGGCCATATTAGAGATTTCCAGATAACTGCTT |
| | CTGGTCAGTATGGCCAGTGGGCCCCCAAGCTTGCTAGACTTCACTACAGTGGTTCAATAAATGCCTGGTCCACCAAGGAGCCCTTCAGCTGGATTAAA |
| | GTGGACTTGCTAGCCCCCATGATCATTCATGGGATAAAAACACAGGGTGCCAGACAGAAATTTTCATCTCTGTACATCAGCCAGTTTATCATCATGTA |
| | CAGTCTGGATGGCAAAAAATGGCAGACCTACAGAGGTAACTCTACAGGTACACTAATGGTATTTTTTGGCAATGTAGATTCATCAGGTATCAAGCATA |
| | ATATCTTTAATCCTCCCATTATTGCCAGATACATCAGGTTGCACCCAACTCATTACAGTATAAGATCCACTTTAAGGATGGAGCTTATGGGGTGTGAC |
| | CTTAATAGCTGCAGTATGCCCTTGGGAATGGAAAGTAAGGCCATATCAGATGCCCAGATTACTGCAAGCAGCTACTTTACAAACATGTTTGCAACCTG |
| | GTCTCCTAGTAAAGCCAGGCTGCACTTGCAGGGTAGGAGCAATGCATGGAGACCCCAGGTCAATAACCCAAAAGAGTGGCTTCAAGTTGACTTTCAAA |
| | AGACAATGAAGGTAACAGGGGTAACCACCCAAGGGGTAAAGAGTCTGCTGACATCTATGTATGTAAAAGAATTCCTCATCTCAAGTAGTCAAGATGGG |
| | CACCAGTGGACACTGTTCTTCCAGAATGGAAAAGTTAAGGTGTTCCAAGGTAATCAAGACAGCTTCACTCCAGTGGTGAACAGTCTGGATCCACCACT |
| | CCTAACCAGGTACCTGAGGATCCACCCTCAGTCCTGGGTCCACCAGATAGCTCTGAGAATGGAAGTGCTGGGCTGTGAAGCTCAGGACCTATACTGAT |
| | TAATTAATAAAATACAGCATAGCAAAACTTTAACCTCCAAATCAAGCCTCTACTTGAATCCTTTTCTGAGGGATGAATAAGGCATAGGCATCAGGGGC |
| | TGTTGCCAATGTGCATTAGCTGTTTGCAGCCTCACCTTCTTTCATGGAGTTTAAGATATAGTGTATTTTCCCAAGGTTTGAACTAGCTCTTCATTTCT |
| | TTATGTTTTAAATGCACTGACCTCCCACATTCCCTTTTTAGTAAAATATTCAGAAATAATTTAAATACATCATTGCAATGAAAATAAATGTTTTTTAT |
| | TAGGCAGAATCCAGATGCTCAAGGCCCTTCATAATATCCCCCAGTTTAGTAGTTGGACTTAGGGAACAAAGGAACCTTTAATAGAAATTGGACAGCAA |
| | GAAAGCGAGCTCCATAAAGTAGGAAACACTACACGATTCCATAAAGTAGGAAACACTACATCACTCCATAAAGTAGGAAACACTACACAGACATGATA |
| | AGATACATTGATGAGTTTGGACAAACCACAACTAGAATGCAGTGAAAAAAATGCTTTATTTGTGAAATTTGTGATGCTATTGCTTTATTTGTAACCAT |
| | TATAAGCTGCAATAAACAAGTTAACAACAACAATTGCATTCATTTTATGTTTCAGGTTCAGGGGGAGATGTGGGAGGTTTTTTAAAGCAAGTAAAACC |
| | TCTACAAATGTGGTACTTAAGCATGGCTACGTAGATAAGTAGCATGGCGGGTTAATCATTAACTACACCTGCAGGAGGAACCCCTAGTGATGGAGTTG |
| | GCCACTCCCTCTCTGCGCGCTCGCTCGCTCACTGAGGCCGGGCGACCAAAGGTCGCCCGACGCCCGGGCGGCCTCAGTGAGCGAGCGAGCGCGCAGCT |
| | GCCTGCAGGGGCGCGCCGCTAGCAGCTGATGCATAGCATGCGGTACCGGGAGATGGGGGAGGCTAACTGAAACACGGAAGGAGACAATACCGGAAGGA |
| | ACCCGCGCTATGACGGCAATAAAAAGACAGAATAAAACGCACGGGTGTTGGGTCGTTTGTTCATAAACGCGGGGTTCGGTCCCAGGGCTGGCACTCTG |
| | TCGATACCCCACCGAGACCCCATTGGGACCAATACGCCCGCGTTTCTTCCTTTTCCCCACCCCAACCCCCAAGTTCGGGTGAAGGCCCAGGGCTCGCA |
| | GCCAACGTCGGGGCGGCAAGCCCTGCCATAGCCACTACGGGTACGTAGGCCAACCACTAGAACTATAGCTAGAGTCCTGGGCGAACAAACGATGCTCG |
| | CCTTCCAGAAAACCGAGGATGCGAACCACTTCATCCGGGGTCAGCACCACCGGCAAGCGCCGCGACGGCCGAGGTCTACCGATCTCCTGAAGCCAGGG |
| | CAGATCCGTGCACAGCACCTTGCCGTAGAAGAACAGCAAGGCCGCCAATGCCTGACGATGCGTGGAGACCGAAACCTTGCGCTCGTTCGCCAGCCAGG |
| | ACAGAAATGCCTCGACTTCGCTGCTGCCCAAGGTTGCCGGGTGACGCACACCGTGGAAACGGATGAAGGCACGAACCCAGTTGACATAAGCCTGTTCG |
| | GTTCGTAAACTGTAATGCAAGTAGCGTATGCGCTCACGCAACTGGTCCAGAACCTTGACCGAACGCAGCGGTGGTAACGGCGCAGTGGCGGTTTTCAT |
| | GGCTTGTTATGACTGTTTTTTTGTACAGTCTATGCCTCGGGCATCCAAGCAGCAAGCGCGTTACGCCGTGGGTCGATGTTTGATGTTATGGAGCAGCA |
| | ACGATGTTACGCAGCAGCAACGATGTTACGCAGCAGGGCAGTCGCCCTAAAACAAAGTTAGGTGGCTCAAGTATGGGCATCATTCGCACATGTAGGCT |
| | CGGCCCTGACCAAGTCAAATCCATGCGGGCTGCTCTTGATCTTTTCGGTCGTGAGTTCGGAGACGTAGCCACCTACTCCCAACATCAGCCGGACTCCG |
| | ATTACCTCGGGAACTTGCTCCGTAGTAAGACATTCATCGCGCTTGCTGCCTTCGACCAAGAAGCGGTTGTTGGCGCTCTCGCGGCTTACGTTCTGCCC |
| | AGGTTTGAGCAGCCGCGTAGTGAGATCTATATCTATGATCTCGCAGTCTCCGGCGAGCACCGGAGGCAGGGCATTGCCACCGCGCTCATCAATCTCCT |
| | CAAGCATGAGGCCAACGCGCTTGGTGCTTATGTGATCTACGTGCAAGCAGATTACGGTGACGATCCCGCAGTGGCTCTCTATACAAAGTTGGGCATAC |
| | GGGAAGAAGTGATGCACTTTGATATCGACCCAAGTACCGCCACCTAACAATTCGTTCAAGCCGAGATCGGCTTCCCGGCCGCGGAGTTGTTCGGTAAA |
| | TTGTCACAACGCCGCGAATATAGTCTTTACCATGCCCTTGGCCACGCCCCTCTTTAATACGACGGGCAATTTGCACTTCAGAAAATGAAGAGTTTGCT |
| | TTAGCCATAACAAAAGTCCAGTATGCTTTTTCACAGCATAACTGGACTGATTTCAGTTTACAACTATTCTGTCTAGTTTAAGACTTTATTGTCATAGT |
| | TTAGATCTATTTTGTTCAGTTTAAGACTTTATTGTCCGCCCACACCCGCTTACGCAGGGCATCCATTTATTACTCAACCGTAACCGATTTTGCCAGGT |
| | TACGCGGCTGGTCTGCGGTGTGAAATACCGCACAGATGCGTAAGGAGAAAATACCGCATCAGGCGCTCTTCCGCTTCCTCGCTCACTGACTCGCTGCG |
| | CTCGGTCGTTCGGCTGCGGCGAGCGGTATCAGCTCACTCAAAGGCGGTAATACGGTTATCCACAGAATCAGGGGATAACGCAGGAAAGAACATGTGAG |
| | CAAAAGGCCAGCAAAAGGCCAGGAACCGTAAAAAGGCCGCGTTGCTGGCGTTTTTCCATAGGCTCCGCCCCCCTGACGAGCATCACAAAAATCGACGC |
| | TCAAGTCAGAGGTGGCGAAACCCGACAGGACTATAAAGATACCAGGCGTTTCCCCCTGGAAGCTCCCTCGTGCGCTCTCCTGTTCCGACCCTGCCGCT |
| | TACCGGATACCTGTCCGCCTTTCTCCCTTCGGGAAGCGTGGCGCTTTCTCAATGCTCACGCTGTAGGTATCTCAGTTCGGTGTAGGTCGTTCGCTCCA |
| | AGCTGGGCTGTGTGCACGAACCCCCCGTTCAGCCCGACCGCTGCGCCTTATCCGGTAACTATCGTCTTGAGTCCAACCCGGTAAGACACGACTTATCG |
| | CCACTGGCAGCAGCCACTGGTAACAGGATTAGCAGAGCGAGGTATGTAGGCGGTGCTACAGAGTTCTTGAAGTGGTGGCCTAACTACGGCTACACTAG |
| | AAGGACAGTATTTGGTATCTGCGCTCTGCTGAAGCCAGTTACCTTCGGAAAAAGAGTTGGTAGCTCTTGATCCGGCAAACAAACCACCGCTGGTAGCG |
| | GTGGTTTTTTTGTTTGCAAGCAGCAGATTACGCGCAGAAAAAAAGGATCTCAAGAAGATCCTTTGATCTTTTCTACGGGGTCTGACGCTCAGTGGAAC |

TABLE 9-continued

| ceDNA Vector Name | Nucleic Acid Sequence |
|---|---|
| | GAAAACTCACGTTAAGGGATTTTGGTCATGAGATTATCAAAAAGGATCTTCACCTAGATCCTTTTAAATTAAAAATGAAGTTTTAAATCAATCTAAAG<br>TATATATGAGTAAACTTGGTCTGACAGTTACCAATGCTTAATCAGTGAGGCACCTATCTCAGCGATCTGTCTATTTCGTTCATCCATAGTTGCCTGAC<br>TCCCCGTCGTGTAGATAACTACGATACGGGAGGGCTTACCATCTGGCCCCAGTGCTGCAATGATACCGCGAGACCCACGCTCACCGGCTCCAGATTTA<br>TCAGCAATAAACCAGCCAGCCGGAAGGGCCGAGCGCAGAAGTGGTCCTGCAACTTTATCCGCCTCCATCCAGTCTATTAATTGTTGCCGGGAAGCTAG<br>AGTAAGTAGTTCGCCAGTTAATAGTTTGCGCAACGTTGTTGCCATTGCTACAGGCATCGTGGTGTCACGCTCGTCGTTTGGTATGGCTTCATTCAGCT<br>CCGGTTCCCAACGATCAAGGCGAGTTACATGATCCCCCATGTTGTGCAAAAAAGCGGTTAGCTCCTTCGGTCCTCCGATCGTTGTCAGAAGTAAGTTG<br>GCCGCAGTGTTATCACTCATGGTTATGGCAGCACTGCATAATTCTCTTACTGTCATGCCATCCGTAAGATGCTTTTCTGTGACTGGTGAGTACTCAAC<br>CAAGTCATTCTGAGAATAGTGTATGCGGCGACCGAGTTGCTCTTGCCCGGCGTCAATACGGGATAATACCGCGCCACATAGCAGAACTTTAAAAGTGC<br>TCATCATTGGAAAACGTTCTTCGGGGCGAAAACTCTCAAGGATCTTACCGCTGTTGAGATCCAGTTCGATGTAACCCACTCGTGCACCCAACTGATCT<br>TCAGCATCTTTTACTTTCACCAGCGTTTCTGGGTGAGCAAAAACAGGAAGGCAAAATGCCGCAAAAAAGGGAATAAGGGCGACACGGAAATGTTGAAT<br>ACTCATACTCTTCCTTTTTCAATATTATTGAAGCATTTATCAGGGTTATTGTCTCATGAGCGGATACATATTTGAATGTATTTAGAAAAATAAACAAA<br>TAGGGGTTCCGCGCACATTTCCCCGAAAAGTGCCACCTGAAATTGTAAACGTTAATATTTTGTTAAAATTCGCGTTAAATTTTTGTTAAATCAGCTCA<br>TTTTTTAACCAATAGGCCGAAATCGGCAAAATCCCTTATAAATCAAAAGAATAGACCGAGATAGGGTTGAGTGTTGTTCCAGTTTGGAACAAGAGTCC<br>ACTATTAAAGAACGTGGACTCCAACGTCAAAGGGCGAAAAACCGTCTATCAGGGCGATGGCCCACTACGTGAACCATCACCCTAATCAAGTTTTTTGG<br>GGTCGAGGTGCCGTAAAGCACTAAATCGGAACCCTAAAGGGAGCCCCCGATTTAGAGCTTGACGGGGAAAGCCGGCGAACGTGGCGAGAAAGGAAGGG<br>AAGAAAGCGAAAGGAGCGGGCGCTAGGGCGCTGGCAAGTGTAGCGGTCACGCTGCGCGTAACCACCACACCCGCCGCGCTTAATGCGCCGCTACAGGG<br>CGCGTCCCATTCGCCATTCAGGCTGCAAATAAGCGTTGATATTCAGTCAATTACAAACATTAATAACGAAGAGATGACAGAAAAATTTTCATTCTGTG<br>ACAGAGAA |
| ceDNAFVIII-vector 26 (SEQ ID NO: 217) | AAAGTAGCCGAAGATGACGGTTTGTCACATGGAGTTGGCAGGATGTTTGATTAAAAACATAACAGGAAGAAAAATGCCCCGCTGTGGGCGGACAAAAT<br>AGTTGGGAACTGGGAGGGGTGGAAATGGAGTTTTTAAGGATTATTTAGGGAAGAGTGACAAAATAGATGGGAACTGGGTGTAGCGTCGTAAGCTAATA<br>CGAAAATTAAAAATGACAAAATAGTTTGGAACTAGATTTCACTTATCTGGTTCGGATCTCCTAGGCTCAAGCAGTGATCAGATCCAGACATGATAAGA<br>TACATTGATGAGTTTGGACAAACCACAACTAGAATGCAGTGAAAAAAATGCTTTATTTGTGAAATTTGTGATGCTATTGCTTTATTTGTAACCATTAT<br>AAGCTGCAATAAACAAGTTAACAACAACAATTGCATTCATTTTATGTTTCAGGTTCAGGGGGAGGTGTGGGAGGTTTTTTAAAGCAAGTAAAACCTCT<br>ACAAATGTGGTATGGCTGATTATGATCCTCTAGTACTTCTCGACAAGCTTGTCGAGACTGCAGGCTCTAGAGGCCGGCCCCTGCAGGCAGCTGCGCGC<br>TCGCTCGCTCACTGAGGCCGCCCGGGCAAAGCCCGGGCGTCGGGCGACCTTTGGTCGCCCGGCCTCAGTGAGCGAGCGAGCGCGCAGAGAGGGAGTGG<br>CCAACTCCATCACTAGGGGTTCCTTGTAGTTAATGATTAACCCGCCATGCTACTTATCTACGTAGCCATGCATATG**GAGTCAATGGAAAAACCCATT**<br>**GGAGCCAAGTACACTGACTCAATAGGGACTTTCCATTGGGTTTTGCCCAGTACATAAGGTCAATAGGGGGTGAGTCAACAGGAAAGTCCCATTGGAGC**<br>**CAAGTACATTGAGTCAATAGGGACTTTCCAATGGGTTTTGCCCAGTACATAAGGTCAATGGGAGGTAAGCCAATGGGTTTTTCCCATTACTGACATGT**<br>**ATACTGAGTCATTAGGGACTTTCCAATGGGTTTTGCC**CAGTACATAAGGTCAATAGGGGTGAATCAACAGGAAAGTCCCATTGGAGCCAAGTACACTG<br>AGTCAATAGGGACTTTCCATTGGGTTTTGCCCAGTACAAAAGGTCAATAGGGGGTGAGTCAATGGGTTTTTCCCATTATTGGCACATACATAAGGTCA<br>ATAGGGGTGACTAGTGGAGAAGAGCATGCTTGAGGGCTGAGTGCCCCTCAGTGGGCAGAGAGCACATGGCCCACAGTCCCTGAGAAGTTGGGGGGAGG<br>GGTGGGCAATTGAACTGGTGCCTAGAGAAGGTGGGGCTTGGGTAAACTGGGAAAGTGATGTGGTGTACTGGCTCCACCTTTTTCCCCAGGGTGGGGGA<br>GAACCATATATAAGTGCAGTAGTCTCTGTGAACATTCAAGCTTCTGCCTTCTCCCTCCTGTGAGTTTGGTAAGTCACTGACTGTCTATGCCTGGGAAA<br>GGGTGGGCAGGAGATGGGGCAGTGCAGGAAAAGTGGCACTATGAACCCTGCAGCCCTAGACAATTGTACTAACCTTCTTCTCTTTCCTCTCCTGACAG<br>GTTGGTGTACAGTAGCTTCCGTTTAAACAGCCACCATGCAAATAGAGCTCTCCACCTGCTTCTTTCTGTGCCTTTTGCGATTCTGCTTTAGTGCCACC<br>AGAAGATACTACCTGGGTGCAGTGGAACTGTCATGGGACTATATGCAAAGTGATCTCGGTGAGCTGCCTGTGGACGCAAGATTTCCTCCTAGAGTGCC<br>AAAATCTTTTCCATTCAACACCTCAGTCGTGTACAAAAAGACTCTGTTTGTAGAATTCACGGATCACCTTTTCAACATCGCTAAGCCAAGGCCACCCT<br>GGATGGGTCTGCTAGGTCCTACCATCCAGGCTGAGGTTTATGATACAGTGGTCATTACACTTAAGAACATGGCTTCCCATCCTGTCAGTCTTCATGCT<br>GTTGGTGTATCCTACTGGAAAGCTTCTGAGGGAGCTGAATATGATGATCAGACCAGTCAAAGGGAGAAAGAAGATGATAAAGTCTTCCCTGGTGGAAG<br>CCATACATATGTCTGGCAGGTCCTGAAAGAGAATGGTCCAATGGCCTCTGACCCACTGTGCCTTACCTACTCATATCTTTCTCATGTGGACCTGGTAA<br>AAGACTTGAATTCAGGCCTCATTGGAGCCCTACTAGTATGTAGAGAAGGGAGTCTGGCCAAGGAAAAGACACAGACCTTGCACAAATTTATACTACTT<br>TTTGCTGTATTTGATGAAGGGAAAAGTTGGCACTCAGAAACAAAGAACTCCTTGATGCAGGATAGGGATGCTGCATCTGCTCGGGCCTGGCCTAAAAT<br>GCACACAGTCAATGGTTATGTAAACAGGTCTCTGCCAGGTCTGATTGGATGCCACAGGAAATCAGTCTATTGGCATGTGATTGGAATGGGCACCACTC<br>CTGAAGTGCACTCAATATTCCTCGAAGGTCACACATTTCTTGTGAGGAACCATCGCCAGGCGTCCTTGGAAATCTCGCCAATAACTTTCCTTACTGCT<br>CAAACACTCTTGATGGACCTTGGACAGTTTCTACTGTTTTGTCATATCTCTTCCCACCAACATGATGGCATGGAAGCTTATGTCAAAGTAGACAGCTG<br>TCCAGAGGAACCCCAACTACGAATGAAAAATAATGAAGAAGCGGAAGACTATGATGATGATCTTACTGATTCTGAAATGGATGTGGTCAGGTTTGATG<br>ATGACAACTCTCCTTCCTTTATCCAAATTCGCTCAGTTGCCAAGAAGCATCCTAAAACTTGGGTACATTACATTGCTGCTGAAGAGGAGGACTGGGAC<br>TATGCTCCCTTAGTCCTCGCCCCCGATGACAGAAGTTATAAAAGTCAATATTTGAACAATGGCCCTCAGCGGATTGGTAGGAAGTACAAAAAAGTCCG<br>ATTTATGGCATACACAGATGAAACCTTTAAGACTCGTGAAGCTATTCAGCATGAATCAGGAATCTTGGGACCTTTACTTTATGGGGAAGTTGGAGACA |

TABLE 9-continued

| ceDNA Vector Name | Nucleic Acid Sequence |
|---|---|
| | CACTGTTGATTATATTTAAGAATCAAGCAAGCAGACCATATAACATCTACCCTCACGGAATCACTGATGTCCGTCCTTTGTATTCAAGGAGATTACCA<br>AAAGGTGTAAAACATTTGAAGGATTTTCCAATTCTGCCAGGAGAAATATTCAAATATAAATGGACAGTGACTGTAGAAGATGGGCCAACTAAATCAGA<br>TCCTCGGTGCCTGACCCGCTATTACTCTAGTTTCGTTAATATGGAGAGAGATCTAGCTTCAGGACTCATTGGCCCTCTCCTCATCTGCTACAAAGAAT<br>CTGTAGATCAAAGAGGAAACCAGATAATGTCAGACAAGAGGAATGTCATCCTGTTTTCTGTATTTGATGAGAACCGAAGCTGGTACCTCACAGAGAAT<br>ATACAACGCTTTCTCCCCAATCCAGCTGGAGTGCAGCTTGAGGATCCAGAGTTCCAAGCCTCCAACATCATGCACAGCATCAATGGCTATGTTTTTGA<br>TAGTTTGCAGTTGTCAGTTTGTTTGCATGAGGTGGCATACTGGTACATTCTAAGCATTGGAGCACAGACTGACTTCCTTTCTGTCTTCTTCTCTGGAT<br>ATACCTTCAAACACAAAATGGTCTATGAAGACACACTCACCCTATTCCCATTCTCAGGAGAAACTGTCTTCATGTCGATGGAAAACCCAGGTCTATGG<br>ATTCTGGGGTGCCACAACTCAGACTTTCGGAACAGAGGCATGACCGCCTTACTGAAGGTTTCTAGTTGTGACAAGAACACTGGTGATTATTACGAGGA<br>CAGTTATGAAGATATTTCAGCATACTTGCTGAGTAAAAACAATGCCATTGAACCAAGAAGCTTCTCCCAGAATTCAAGACACCCTAGCACTAGGCAAA<br>AGCAATTTAATGCCACCACAATTCCAGAAAATGACATAGAGAAGACTGACCCTTGGTTTGCACACAGAACACCTATGCCTAAAATACAAAATGTCTCC<br>TCTAGTGATTTGTTGATGCTCTTGCGACAGAGTCCTACTCCACATGGGCTATCCTTATCTGATCTCCAAGAAGCCAAATATGAGACTTTTTCTGATGA<br>TCCATCACCTGGAGCAATAGACAGTAATAACAGCCTGTCTGAAATGACACACTTCAGGCCACAGCTCCATCACAGTGGGGACATGGTATTTACCCCTG<br>AGTCAGGCCTCCAATTAAGATTAAATGAGAAACTGGGGACAACTGCAGCAACAGAGTTGAAGAAACTTGATTTCAAAGTTTCTAGTACATCAAATAAT<br>CTGATTTCAACAATTCCATCAGACAATTTGGCAGCAGGTACTGATAATACAAGTTCCTTAGGACCCCCAAGTATGCCAGTTCATTATGATAGTCAATT<br>AGATACCACTCTATTTGGCAAAAAGTCATCTCCCCTTACTGAGTCTGGTGGACCTCTGAGCTTGAGTGAAGAAAATAATGATTCAAAGTTGTTAGAAT<br>CAGGTTTAATGAATAGCCAAGAAAGTTCATGGGGAAAAAATGTATCGTCAACAGAGAGTGGTAGGTTATTTAAAGGGAAAAGAGCTCATGGACCTGCT<br>TTGTTGACTAAAGATAATGCCTTATTCAAAGTTAGCATCTCTTTGTTAAAGACAAACAAAACTTCCAATAATTCAGCAACTAATAGAAAGACTCACAT<br>TGATGGCCCATCATTATTAATTGAGAATAGTCCATCAGTCTGGCAAAATATATTAGAAAGTGACACTGAGTTTAAAAAAGTGACACCTTTGATTCATG<br>ACAGAATGCTTATGGACAAAAATGCTACAGCTTTGAGGCTAAATCATATGTCAAATAAAACTACTTCATCAAAAAACATGGAAATGGTCCAACAGAAA<br>AAAGAGGGCCCCATTCCACCAGATGCACAAAATCCAGATATGTCGTTCTTTAAGATGCTATTCTTGCCAGAATCAGCAAGGTGGATACAAAGGACTCA<br>TGGAAAGAACTCTCTGAACTCTGGGCAAGGCCCCAGTCCAAAGCAATTAGTATCCTTAGGACCAGAAAAATCTGTGGAAGGTCAGAATTTCTTGTCTG<br>AGAAAAACAAAGTGGTAGTAGGAAAGGGTGAATTTACAAAGGACGTAGGACTCAAAGAGATGGTTTTTCCAAGCAGCAGAAACCTATTTCTTACTAAC<br>TTGGATAATTTACATGAAAATAATACACACAATCAAGAAAAAAAAATTCAGGAAGAAATAGAAAAGAAGGAAACATTAATCCAAGAGAATGTAGTTTT<br>GCCTCAGATACATACAGTGACTGGCACTAAGAATTTCATGAAGAACCTTTTCTTACTGAGCACTAGGCAAAATGTAGAAGGTTCATATGACGGGGCAT<br>ATGCTCCAGTACTTCAAGATTTTAGGTCATTAAATGATTCAACAAATAGAACAAAGAAACACACAGCTCATTTCTCAAAAAAAGGGGAGGAAGAAAAC<br>TTGGAAGGCTTGGGAAATCAAACCAAGCAAATTGTAGAGAAATATGCATGCACCACAAGGATATCTCCTAATACAAGCCAGCAGAATTTTGTCACGCA<br>ACGTAGTAAGAGAGCTTTGAAACAATTCAGACTCCCACTAGAAGAAACAGAACTTGAAAAAAGGATAATTGTGGATGACACCTCAACCCAGTGGTCCA<br>AAAACATGAAACATTTGACCCCGAGCACCCTCACACAGATAGACTACAATGAGAAGGAGAAAGGGGCCATTACTCAGTCTCCCTTATCAGATTGCCTT<br>ACGAGGAGTCATAGCATCCCTCAAGCAAATAGATCTCCATTACCCATTGCAAAGGTATCATCATTTCCATCTATTAGACCTATATATCTGACCAGGGT<br>CCTATTCCAAGACAACTCTTCTCATCTTCCAGCAGCATCTTATAGAAAGAAAGATTCTGGGGTCCAAGAAAGCAGTCATTTCTTACAAGGAGCCAAAA<br>AAAATAACCTTTCTTTAGCCATTCTAACCTTGGAGATGACTGGTGATCAAAGAGAGGTTGGCTCCCTGGGGACAAGTGCCACAAATTCAGTCACATAC<br>AAGAAAGTTGAGAACACTGTTCTCCCGAAACCAGACTTGCCCAAAACATCTGGCAAAGTTGAATTGCTTCCAAAAGTTCACATTTATCAGAAGGACCT<br>ATTCCCTACGGAAACTAGCAATGGGTCTCCTGGCCATCTGGATCTCGTGGAAGGGAGCCTTCTTCAGGGAACAGAGGGAGCGATTAAGTGGAATGAAG<br>CAAACAGACCTGGAAAAGTTCCCTTTCTGAGAGTAGCAACAGAAAGCTCTGCAAAGACTCCCTCCAAGCTATTGGATCCTCTTGCTTGGGATAACCAC<br>TATGGTACTCAGATACCAAAAGAAGAGTGGAAATCCCAAGAGAAGTCACCAGAAAAAACAGCTTTTAAGAAAAAGGATACCATTTTGTCCCTGAACGC<br>TTGTGAAAGCAATCATGCAATAGCAGCAATAAATGAGGGACAAAATAAGCCCGAAATAGAAGTCACCTGGGCAAAGCAAGGTAGGACTGAAAGGCTGT<br>GCTCTCAAAACCCACCAGTCTTGAAACGCCATCAACGGGAAATAACTCGTACTACTCTTCAGTCAGATCAAGAGGAAATTGACTATGATGATACCATA<br>TCAGTTGAAATGAAGAAGGAAGATTTTGACATTTATGATGAGGATGAAAATCAGAGCCCCCGCAGCTTTCAAAAGAAAACACGACACTATTTTATTGC<br>TGCAGTGGAGAGGCTCTGGGATTATGGGATGAGTAGCTCCCCACATGTTCTAAGAAACAGGGCTCAGAGTGGCAGTGTCCCTCAGTTCAAGAAAGTTG<br>TTTTCCAGGAATTTACTGATGGCTCCTTTACTCAGCCCTTATACCGTGGAGAACTAAATGAACATTTGGGACTCCTGGGGCCATATATAAGAGCAGAA<br>GTTGAAGATAATATCATGGTAACTTTCAGAAATCAGGCCTCTCGTCCCTATTCCTTCTATTCTAGCCTTATTTCTTATGAGGAAGATCAGAGGCAAGG<br>AGCAGAACCTAGAAAAAACTTTGTCAAGCCTAATGAAACCAAAACTTACTTTTGGAAAGTGCAACATCATATGGCACCCACTAAAGATGAGTTTGACT<br>GCAAAGCCTGGGCTTATTTCTCTGATGTTGACCTGGAAAAAGATGTGCACTCAGGCCTGATTGGACCCCTTCTGGTCTGCCACACTAACACACTGAAC<br>CCTGCTCATGGGAGACAAGTGACAGTACAGGAATTTGCTCTGTTTTTCACCATCTTTGATGAGACCAAAAGCTGGTACTTCACTGAAAATATGGAAAG<br>AAACTGCAGGGCTCCCTGCAATATCCAGATGGAAGATCCCACTTTTAAAGAGAATTATCGCTTCCATGCAATCAATGGCTACATAATGGATACACTAC<br>CTGGCTTAGTAATGGCTCAGGATCAAAGGATTCGATGGTATCTGCTCAGCATGGGCAGCAATGAAAACATCCATTCTATTCATTTCAGTGGACATGTG<br>TTCACTGTACGAAAAAAAGAGGAGTATAAAATGGCACTGTACAATCTCTATCCAGGTGTTTTTGAGACAGTGGAAATGTTACCATCCAAAGCTGGAAT<br>TTGGCGGGTGGAATGCCTTATTGGCGAGCATCTACATGCTGGGATGAGCACACTTTTTCTGGTGTACAGCAATAAGTGTCAGACTCCCCTGGGAATGG<br>CTTCTGGACACATTAGAGATTTTCAGATTACAGCTTCAGGACAATATGGACAGTGGGCCCCAAAGCTGGCCAGACTTCATTATTCCGGATCAATCAAT<br>GCCTGGAGCACCAAGGAGCCCTTTTCTTGGATCAAGGTGGATCTGTTGGCACCAATGATTATTCACGGCATCAAGACCCAGGTGCCCGTCAGAAGTT |

TABLE 9-continued

| ceDNA Vector Name | Nucleic Acid Sequence |
| --- | --- |
| | CTCCAGCCTCTACATCTCTCAGTTTATCATCATGTATAGTCTTGATGGGAAGAAGTGGCAGACTTATCGAGGAAATTCCACTGGAACCTTAATGGTCT |
| | TCTTTGGCAATGTGGATTCATCTGGGATAAAACACAATATTTTTAACCCTCCAATTATTGCTCGATACATCCGTTTGCACCCAACTCATTATAGCATT |
| | CGCAGCACTCTTCGCATGGAGTTGATGGGCTGTGATTTAAATAGTTGCAGCATGCCATTGGGAATGGAGAGTAAAGCAATATCAGATGCACAGATTAC |
| | TGCTTCATCCTACTTTACCAATATGTTTGCCACCTGGTCTCCTTCAAAAGCTCGACTTCACCTCCAAGGGAGGAGTAATGCCTGGAGACCTCAGGTGA |
| | ATAATCCAAAAGAGTGGCTGCAAGTGGACTTCCAGAAGACAATGAAAGTCACAGGAGTAACTACTCAGGGAGTAAAATCTCTGCTTACCAGCATGTAT |
| | GTGAAGGAGTTCCTCATCTCCAGCAGTCAAGATGGCCATCAGTGGACTCTCTTTTTTCAGAATGGCAAAGTAAAGGTTTTTCAGGGAAATCAAGACTC |
| | CTTCACACCTGTGGTGAACTCTCTAGACCCACCGTTACTGACTCGCTACCTTCGAATTCACCCCCAGAGTTGGGTGCACCAGATTGCCCTGAGGATGG |
| | AGGTTCTGGGCTGCGAGGCACAGGACCTCTACTGATTAATTAATAAAATACAGCATAGCAAAACTTTAACCTCCAAATCAAGCCTCTACTTGAATCCT |
| | TTTCTGAGGGATGAATAAGGCATAGGCATCAGGGGCTGTTGCCAATGTGCATTAGCTGTTTGCAGCCTCACCTTCTTTCATGGAGTTTAAGATATAGT |
| | GTATTTTCCCAAGGTTTGAACTAGCTCTTCATTTCTTTATGTTTTAAATGCACTGACCTCCCACATTCCCTTTTTAGTAAAATATTCAGAAATAATTT |
| | AAATACATCATTGCAATGAAAATAAATGTTTTTTATTAGGCAGAATCCAGATGCTCAAGGCCCTTCATAATATCCCCCAGTTTAGTAGTTGGACTTAG |
| | GGAACAAAGGAACCTTTAATAGAAATTGGACAGCAAGAAAGCGAGCTCCATAAAGTAGGAAACACTACACGATTCCATAAAGTAGGAAACACTACATC |
| | ACTCCATAAAGTAGGAAACACTACACAGACATGATAAGATACATTGATGAGTTTGGACAAACCACAACTAGAATGCAGTGAAAAAAATGCTTTATTTG |
| | TGAAATTTGTGATGCTATTGCTTTATTTGTAACCATTATAAGCTGCAATAAACAAGTTAACAACAACAATTGCATTCATTTTATGTTTCAGGTTCAGG |
| | GGGAGATGTGGGAGGTTTTTTAAAGCAAGTAAAACCTCTACAAATGTGGTACTTAAGCATGGCTACGTAGATAAGTAGCATGGCGGGTTAATCATTAA |
| | CTACACCTGCAGGAGGAACCCCTAGTGATGGAGTTGGCCACTCCCTCTCTGCGCGCTCGCTCGCTCACTGAGGCCGGGCGACCAAAGGTCGCCCGACG |
| | CCCGGGCGGCCTCAGTGAGCGAGCGAGCGCGCAGCTGCCTGCAGGGGCGCGCCGCTAGCAGCTGATGCATAGCATGCGGTACCGGGAGATGGGGGAGG |
| | CTAACTGAAACACGGAAGGAGACAATACCGGAAGGAACCCGCGCTATGACGGCAATAAAAAGACAGAATAAAACGCACGGGTGTTGGGTCGTTTGTTC |
| | ATAAACGCGGGGTTCGGTCCCAGGGCTGGCACTCTGTCGATACCCCACCGAGACCCCATTGGGACCAATACGCCCGCGTTTCTTCCTTTTCCCCACCC |
| | CAACCCCCAAGTTCGGGTGAAGGCCCAGGGCTCGCAGCCAACGTCGGGGCGGCAAGCCCTGCCATAGCCACTACGGGTACGTAGGCCAACCACTAGAA |
| | CTATAGCTAGAGTCCTGGGCGAACAAACGATGCTCGCCTTCCAGAAAACCGAGGATGCGAACCACTTCATCCGGGGTCAGCACCACCGGCAAGCGCCG |
| | CGACGGCCGAGGTCTACCGATCTCCTGAAGCCAGGGCAGATCCGTGCACAGCACCTTGCCGTAGAAGAACAGCAAGGCCGCCAATGCCTGACGATGCG |
| | TGGAGACCGAAACCTTGCGCTCGTTCGCCAGCCAGGACAGAAATGCCTCGACTTCGCTGCTGCCCAAGGTTGCCGGGTGACGCACACCGTGGAAACGG |
| | ATGAAGGCACGAACCCAGTTGACATAAGCCTGTTCGGTTCGTAAACTGTAATGCAAGTAGCGTATGCGCTCACGCAACTGGTCCAGAACCTTGACCGA |
| | ACGCAGCGGTGGTAACGGCGCAGTGGCGGTTTTCATGGCTTGTTATGACTGTTTTTTTGTACAGTCTATGCCTCGGGCATCCAAGCAGCAAGCGCGTT |
| | ACGCCGTGGGTCGATGTTTGATGTTATGGAGCAGCAACGATGTTACGCAGCAGCAACGATGTTACGCAGCAGGGCAGTCGCCCTAAAACAAAGTTAGG |
| | TGGCTCAAGTATGGGCATCATTCGCACATGTAGGCTCGGCCCTGACCAAGTCAAATCCATGCGGGCTGCTCTTGATCTTTTCGGTCGTGAGTTCGGAG |
| | ACGTAGCCACCTACTCCCAACATCAGCCGGACTCCGATTACCTCGGGAACTTGCTCCGTAGTAAGACATTCATCGCGCTTGCTGCCTTCGACCAAGAA |
| | GCGGTTGTTGGCGCTCTCGCGGCTTACGTTCTGCCCAGGTTTGAGCAGCCGCGTAGTGAGATCTATATCTATGATCTCGCAGTCTCCGGCGAGCACCG |
| | GAGGCAGGGCATTGCCACCGCGCTCATCAATCTCCTCAAGCATGAGGCCAACGCGCTTGGTGCTTATGTGATCTACGTGCAAGCAGATTACGGTGACG |
| | ATCCCGCAGTGGCTCTCTATACAAAGTTGGGCATACGGGAAGAAGTGATGCACTTTGATATCGACCCAAGTACCGCCACCTAACAATTCGTTCAAGCC |
| | GAGATCGGCTTCCCGGCCGCGGAGTTGTTCGGTAAATTGTCACAACGCCGCGAATATAGTCTTTACCATGCCCTTGGCCACGCCCCTCTTTAATACGA |
| | CGGGCAATTTGCACTTCAGAAAATGAAGAGTTTGCTTTAGCCATAACAAAAGTCCAGTATGCTTTTTCACAGCATAACTGGACTGATTTCAGTTTACA |
| | ACTATTCTGTCTAGTTTAAGACTTTATTGTCATAGTTTAGATCTATTTTGTTCAGTTTAAGACTTTATTGTCCGCCCACACCCGCTTACGCAGGGCAT |
| | CCATTTATTACTCAACCGTAACCGATTTTGCCAGGTTACGCGGCTGGTCTGCGGTGTGAAATACCGCACAGATGCGTAAGGAGAAAATACCGCATCAG |
| | GCGCTCTTCCGCTTCCTCGCTCACTGACTCGCTGCGCTCGGTCGTTCGGCTGCGGCGAGCGGTATCAGCTCACTCAAAGGCGGTAATACGGTTATCCA |
| | CAGAATCAGGGGATAACGCAGGAAAGAACATGTGAGCAAAAGGCCAGCAAAAGGCCAGGAACCGTAAAAAGGCCGCGTTGCTGGCGTTTTTCCATAGG |
| | CTCCGCCCCCCTGACGAGCATCACAAAAATCGACGCTCAAGTCAGAGGTGGCGAAACCCGACAGGACTATAAAGATACCAGGCGTTTCCCCCTGGAAG |
| | CTCCCTCGTGCGCTCTCCTGTTCCGACCCTGCCGCTTACCGGATACCTGTCCGCCTTTCTCCCTTCGGGAAGCGTGGCGCTTTCTCAATGCTCACGCT |
| | GTAGGTATCTCAGTTCGGTGTAGGTCGTTCGCTCCAAGCTGGGCTGTGTGCACGAACCCCCCGTTCAGCCCGACCGCTGCGCCTTATCCGGTAACTAT |
| | CGTCTTGAGTCCAACCCGGTAAGACACGACTTATCGCCACTGGCAGCAGCCACTGGTAACAGGATTAGCAGAGCGAGGTATGTAGGCGGTGCTACAGA |
| | GTTCTTGAAGTGGTGGCCTAACTACGGCTACACTAGAAGGACAGTATTTGGTATCTGCGCTCTGCTGAAGCCAGTTACCTTCGGAAAAAGAGTTGGTA |
| | GCTCTTGATCCGGCAAACAAACCACCGCTGGTAGCGGTGGTTTTTTTGTTTGCAAGCAGCAGATTACGCGCAGAAAAAAAGGATCTCAAGAAGATCCT |
| | TTGATCTTTTCTACGGGGTCTGACGCTCAGTGGAACGAAAACTCACGTTAAGGGATTTTGGTCATGAGATTATCAAAAAGGATCTTCACCTAGATCCT |
| | TTTAAATTAAAAATGAAGTTTTAAATCAATCTAAAGTATATATGAGTAAACTTGGTCTGACAGTTACCAATGCTTAATCAGTGAGGCACCTATCTCAG |
| | CGATCTGTCTATTTCGTTCATCCATAGTTGCCTGACTCCCCGTCGTGTAGATAACTACGATACGGGAGGGCTTACCATCTGGCCCCAGTGCTGCAATG |
| | ATACCGCGAGACCCACGCTCACCGGCTCCAGATTTATCAGCAATAAACCAGCCAGCCGGAAGGGCCGAGCGCAGAAGTGGTCCTGCAACTTTATCCGC |
| | CTCCATCCAGTCTATTAATTGTTGCCGGGAAGCTAGAGTAAGTAGTTCGCCAGTTAATAGTTTGCGCAACGTTGTTGCCATTGCTACAGGCATCGTGG |
| | TGTCACGCTCGTCGTTTGGTATGGCTTCATTCAGCTCCGGTTCCCAACGATCAAGGCGAGTTACATGATCCCCCATGTTGTGCAAAAAAGCGGTTAGC |
| | TCCTTCGGTCCTCCGATCGTTGTCAGAAGTAAGTTGGCCGCAGTGTTATCACTCATGGTTATGGCAGCACTGCATAATTCTCTTACTGTCATGCCATC |

TABLE 9-continued

| ceDNA Vector Name | Nucleic Acid Sequence |
| --- | --- |
| | CGTAAGATGCTTTTCTGTGACTGGTGAGTACTCAACCAAGTCATTCTGAGAATAGTGTATGCGGCGACCGAGTTGCTCTTGCCCGGCGTCAATACGGG<br>ATAATACCGCGCCACATAGCAGAACTTTAAAAGTGCTCATCATTGGAAAACGTTCTTCGGGGCGAAAACTCTCAAGGATCTTACCGCTGTTGAGATCC<br>AGTTCGATGTAACCCACTCGTGCACCCAACTGATCTTCAGCATCTTTTACTTTCACCAGCGTTTCTGGGTGAGCAAAAACAGGAAGGCAAAATGCCGC<br>AAAAAAGGGAATAAGGGCGACACGGAAATGTTGAATACTCATACTCTTCCTTTTTCAATATTATTGAAGCATTTATCAGGGTTATTGTCTCATGAGCG<br>GATACATATTTGAATGTATTTAGAAAAATAAACAAATAGGGGTTCCGCGCACATTTCCCCGAAAAGTGCCACCTGAAATTGTAAACGTTAATATTTTG<br>TTAAAATTCGCGTTAAATTTTTGTTAAATCAGCTCATTTTTTAACCAATAGGCCGAAATCGGCAAAATCCCTTATAAATCAAAAGAATAGACCGAGAT<br>AGGGTTGAGTGTTGTTCCAGTTTGGAACAAGAGTCCACTATTAAAGAACGTGGACTCCAACGTCAAAGGGCGAAAAACCGTCTATCAGGGCGATGGCC<br>CACTACGTGAACCATCACCCTAATCAAGTTTTTTGGGGTCGAGGTGCCGTAAAGCACTAAATCGGAACCCTAAAGGGAGCCCCCGATTTAGAGCTTGA<br>CGGGGAAAGCCGGCGAACGTGGCGAGAAAGGAAGGGAAGAAAGCGAAAGGAGCGGGCGCTAGGGCGCTGGCAAGTGTAGCGGTCACGCTGCGCGTAAC<br>CACCACACCCGCCGCGCTTAATGCGCCGCTACAGGGCGCGTCCCATTCGCCATTCAGGCTGCAAATAAGCGTTGATATTCAGTCAATTACAAACATTA<br>ATAACGAAGAGATGACAGAAAAATTTTCATTCTGTGACAGAGAA |

| ceDNA Vector Name | Elements arranged from 5' to 3' (Left ITR to Right ITR) |
|---|---|
| ceDNAFVIII-vector 1 | left-ITR_v1-spacer_left-ITR_v1-NotI_site-hAAT_PromoterSet-PmeI_site-Mod_Minimum_Consensus_Kozak-hFactorVIII_WT_ORF_v2-PacI_site-WPRE_3pUTR-bGH-spacer_right-ITR_v1-right-ITR_v1 |
| ceDNAFVIII-vector 2 | left-ITR_v1-spacer_left-ITR_v1-NotI_site-hAAT_PromoterSet-PmeI_site-Mod_Minimum_Consensus_Kozak-hVIII-BDD-SQ_codopOZ-PacI_site-WPRE_3pUTR-bGH-spacer_right-ITR_v1-right-ITR_v1 |
| ceDNAFVIII-vector 3 | left-ITR_v1-spacer_left-ITR_v1-NotI_site-LPl_Promoter_Set-PmeI_site-Mod_Minimum_Consensus_Kozak-hFactorVIII_WT_ORF_v2-PacI_site-WPRE_3pUTR-bGH-spacer_right-ITR_v1-right-ITR_v1 |
| ceDNAFVIII-vector 4 | left-ITR_v1-spacer_left-ITR_v1-NotI_site-LPl_Promoter_Set-PmeI_site-Mod_Minimum_Consensus_Kozak-hVIII-BDD-SQ_codopOZ-PacI_site-WPRE_3pUTR-bGH-spacer_right-ITR_v1-right-ITR_v1 |
| ceDNAFVIII-vector 5 | left-ITR_v1-spacer_left-ITR_v1-NotI_site-hEF1a_FullLength_Promoter-PmeI_site-Mod_Minimum_Consensus_Kozak-hFactorVIII_WT_ORF_v2-PacI_site-WPRE_3pUTR-bGH-spacer_right-ITR_v1-right-ITR_v1 |
| ceDNAFVIII-vector 6 | left-ITR_v1-spacer_left-ITR_v1-NotI_site-hEF1a_FullLength_Promoter-PmeI_site-Mod_Minimum_Consensus_Kozak-hVIII-BDD-SQ_codopOZ-PacI_site-WPRE_3pUTR-bGH-spacer_right-ITR_v1-right-ITR_v1 |
| ceDNAFVIII-vector 7 | left-ITR_v1-spacer_left-ITR_v1-NotI_site-LPl_Promoter_Set-PmeI_site-Mod_Minimum_Consensus_Kozak-hFactorVIII_206variant_ORF_v1-PacI_site-WPRE_3pUTR-bGH-spacer_right-ITR_v1-right-ITR_v1 |
| ceDNAFVIII-vector 8 | left-ITR_v1-spacer_left-ITR_v1-NotI_site-hEF1a_FullLength_Promoter-PmeI_site-Mod_Minimum_Consensus_Kozak-hFactorVIII_206variant_ORF_v1-PacI_site-WPRE_3pUTR-bGH-spacer_right-ITR_v1-right-ITR_v1 |
| ceDNAFVIII-vector 9 | left-ITR_v1-spacer_left-ITR_v2.1-CMV_enhancer-gB-actin_Promoter-Consensus_Kozak-XbaLsite-PmeI_site-Mod_Minimum_Consensus_Kozak-hVIII-BDD-SQ_codopOZ-PacI_site-WPRE_3pUTR-mir-142_3pUTR-bGH-spacer_right-ITR_v2.1-right-ITR_v1 |
| ceDNAFVIII-vector 10 | left-ITR_v1-spacer_left-ITR_v2.1-hAAT_PromoterSet-PmeI_site-Mod_Minimum_Consensus_Kozak-hVIII-BDD-SQ_codopOZ-PacI_site-WPRE_3pUTR-mir-142_3pUTR-bGH-spacer_right-ITR_v2.1-right-ITR_v1 |
| ceDNAFVIII-vector 11 | left-ITR_v1-spacer_left-ITR_v2.1-VandenDriessche_PromoterSet-PmeI_site-Mod_Minimum_Consensus_Kozak-hVIII-BDD-SQ_codopOZ-PacI_site-WPRE_3pUTR-bGH-spacer_right-ITR_v1-right-ITR_v1 |
| ceDNAFVIII-vector 12 | left-ITR_v1-spacer_left-ITR_v1-BMN270_Enhancer-BMN270_Promoter-BMN270_5pUTR-BMN270_hFVIII-BDD-SQ-BMN270_polyA-spacer_right-ITR_v1-right-ITR_v1 |
| ceDNAFVIII-vector 13 | left-ITR_v1-spacer_left-ITR_v1-SPK8011_Promoter-SPK8011_5pUTR-SPK8011_hFVIII-BDD-SQ-SPK8011_polyA-spacer_right-ITR_v1-right-ITR_v1 |
| ceDNAFVIII-vector 14 | left-ITR_v1-spacer_left-ITR_v1-Minimum_Consensus_Kozak-TTR_liver_specific_Promoter-SangamoCRMSBS2-Intron3_5pUTR-SangamoCRMSBS2-Intron3_hFVIII-BDD-SQ-SangamoCRMSBS2_polyA-spacer_right-ITR_v1-right-ITR_v1 |
| ceDNAFVIII-vector 15 | left-ITR_v1-spacer_left-ITR_v1-hAAT_PromoterSet-PmeI_site-Consensus_Kozak-hVIII-BDD-SQ_codopOZ-PacI_site-WPRE_3pUTR-bGH-spacer_right-ITR_v1-right-ITR_v1 |
| ceDNAFVIII-vector 16 | left-ITR_v1-spacer_left-ITR_v1-hAAT_PromoterSet-PmeI_site-Consensus_Kozak-Nathwani_hFVIII-BDD-V3-PacI_site-WPRE_3pUTR-bGH-spacer_right-ITR_v1-right-ITR_v1 |
| ceDNAFVIII-vector 17 | left-ITR_v1-spacer_left-ITR_v1-hAAT_PromoterSet-PmeI_site-Consensus_Kozak-Nathwani_hFVIII-BDD-V3-PacI_site-WPRE_3pUTR-mir-142_3pUTR-bGH-spacer_right-ITR_v1-right-ITR_v1 |
| ceDNAFVIII-vector 18 | left-ITR_v1-spacer_left-ITR_v1-VandenDriessche_PromoterSet-PmeI_site-Consensus_Kozak-hVIII-BDD-SQ_codopOZ-PacI_site-WPRE_3pUTR-bGH-spacer_right-ITR_v1-right-ITR_v1 |
| ceDNAFVIII-vector 19 | left-ITR_v1-spacer_left-ITR_v1-VandenDriessche_PromoterSet-PmeI_site-Consensus_Kozak-Nathwani_hFVIII-BDD-V3-PacI_site-WPRE_3pUTR-bGH-spacer_right-ITR_v1-right-ITR_v1 |
| ceDNAFVIII-vector 20 | left-ITR_v1-spacer_left-ITR_v1-VandenDriessche_PromoterSet-PmeI_site-Consensus_Kozak-Nathwani_hFVIII-BDD-V3-PacI_site-WPRE_3pUTR-mir-142_3pUTR-bGH-spacer_right-ITR_v1-right-ITR_v1 |
| ceDNAFVIII-vector 21 | left-ITR_v1-spacer_left-ITR_v1-NotI_site-CAG_PromoterSet-PmeI_site-Consensus_Kozak-hVIII-BDD-SQ_codopOZ-PacI_site-WPRE_3pUTR-mir-142_3pUTR-bGH-spacer_right-ITR_v1-right-ITR_v1 |
| ceDNAFVIII-vector 22 | left-ITR_v1-spacer_left-ITR_v1-CET_PromoterSet-PmeI_site-Consensus_Kozak-Nathwani_hFVIII-BDD-V3-PacI_site-WPRE_3pUTR-mir-142_3pUTR-bGH-XbaLsite-spacer_right-ITR_v1-right-ITR_v1 |
| ceDNAFVIII-vector 23 | left-ITR_v1-spacer_left-ITR_v1-VandenDriessche_PromoterSet-PmeI_site-Consensus_Kozak-hFVIII-226variant-F309S_CpGmin-codop_ORF-PacI_site-WPRE_3pUTR-bGH-spacer_right-ITR_v1-right-ITR_v1 |

-continued

| ceDNA Vector Name | Elements arranged from 5' to 3' (Left ITR to Right ITR) |
|---|---|
| ceDNAFVIII-vector 24 | left-ITR_v1-spacer_left-ITR_v1-VandenDriessche_PromoterSet-PmeI_site-Consensus_Kozak-Endo_hFVIII_cDNA-PacI_site-WPRE_3pUTR-bGH-spacer_right-ITR_v1-right-ITR_v1 |
| ceDNAFVIII-vector 25 | left-ITR_v1-spacer_left-ITR_v2-NdeLsite-CET_PromoterSet-PmeI_site-Mod_Minimum_Consensus_Kozak-hFactorVIII-BDD_CpGmin-codop_ORF-PacI_site-HBB_3pUTR-mir-142_3pUTR-SV40_polyA-spacer_right-ITR_v2-right-ITR_v1 |
| ceDNAFVIII-vector 26 | left-ITR_v1-spacer_left-ITR_v2-NdeLsite-CET_PromoterSet-PmeI_site-Mod_Minimum_Consensus_Kozak-Endo_hFVIII_cDNA-PacI_site-HBB_3pUTR-mir-142_3pUTR-SV40_polyA-spacer_right-ITR_v2-right-ITR_v1 |

Test articles were supplied in a concentrated stock, and stored at nominally 4° C. Formulations were not vortexed or centrifuged. Groups were housed in clear polycarbonate cages with contact bedding on a ventilated rack in a procedure room. Food and filtered tap water acidified with 1N HCl to a targeted pH of 2.5-3.0 were provided to the animals ad libitum. Blood was collected at interim and terminal time points as set forth below:

| Group Number | Sample Collection Times<br>Saphenous or Orbital Bleed | Plasma<br>Terminal |
|---|---|---|
| 1-10 | Days 3 | Day 7 |
| Volume/ Portion | 120 μL whole blood | MOV |
| Processing/ Storage | 120 μI, whole blood was added to tube pre-coated with 13.33 μL of 3.2% sodium citrate and kept ambient until processed One (1) aliquot of plasma Frozen at nominally −70° C. | 600 μI, whole blood was added to tube pre-coated with 66.6 μI, of 3.2% sodium citrate and kept ambient until processed Four (4) aliquots of plasma Frozen at nominally −70° C. |

Blood sample collection was as follows:

| Volume (mL) Whole Blood | Sample Destination | D −3 (~) | D 3, 7, 14, 21 | D28 (terminal) |
|---|---|---|---|---|
| 0.15 | cytokine | | | |
| 0.05 | PHE assay × 2 | 0.05 | 0.05 | 0.6 |
| | total/day (mL) | 0.05 | 0.05 | 0.6 |

Study Details are Provided as Follows:

Species (number, sex, age): C57BL/6 (JAX 000664) mice (N=40 and 4 spare, male, 6 weeks of age at arrival) from Jackson Laboratories.

Class of Compound: ceDNA.

Cage Side Observations: Cage side observations were performed daily.

Clinical Observations: Clinical observations were performed 1, 5-6 and 24 hours post dose on Day 0.

Body Weights: Body weight for all animals was recorded on Days 0, 3 and 7, including prior to euthanasia.

Dose Formulation: Test articles were supplied in a concentration stock. Stock was diluted with PBS immediately prior to use. Prepared materials were stored at ~4° C. (or on wet ice) if dosing was not performed immediately.

Dose Administration: Test Materials were dosed on Day 0 by hydrodynamic IV administration, at a set volume per animal, 90-100 ml/kg (dependent on the lightest animal in the group) via lateral tail vein (dosed within 5 seconds).

Blood Collection: Animals had interim blood collected on Day 3 per the table above. After each collection, animals received 0.5-1.0 mL lactated Ringer's, subcutaneously Animals had blood collected according to the blood collection tables above. For plasma collections, whole blood was collected into non-coated Eppendorf style tubes. Immediately 120 μL was withdrawn and placed into tubes containing 13.33 μL of 3.2% sodium citrate. Blood was gently mixed and maintained ambient until processed. Whole blood samples were centrifuged at 2,000 g for 15 minutes under ambient conditions (20-25° C.). Plasma samples were withdrawn avoiding the cell pack. One (1) aliquot was made and any clotting in the whole blood sample or hemolysis in the plasma was noted. All samples were stored at nominally −70° C. All samples were stored at nominally −70° C. until shipped.

Anesthesia Recovery: Animals were monitored continuously while under anesthesia, during recovery and until mobile.

Euthanasia & Terminal Blood Collection: On Day 7, animals were euthanized by $CO_2$ asphyxiation followed by thoracotomy and exsanguination. Maximum obtainable blood volume was collected by cardiac puncture and processed to serum per facility SOPS and stored in two (2) aliquots. For plasma collections, whole blood was collected by syringe and 600 μL, placed immediately in tubes containing 66.66 μL of 3.2% sodium citrate. Blood was gently mixed and maintained ambient until processed. Whole blood samples were centrifuged at 2,000 g for 15 minutes under ambient conditions (20-25° C.). Plasma samples were withdrawn avoiding the cell pack and four (4) aliquots made. Any clotting in the whole blood sample or hemolysis in the plasma was noted.

Figure 12:
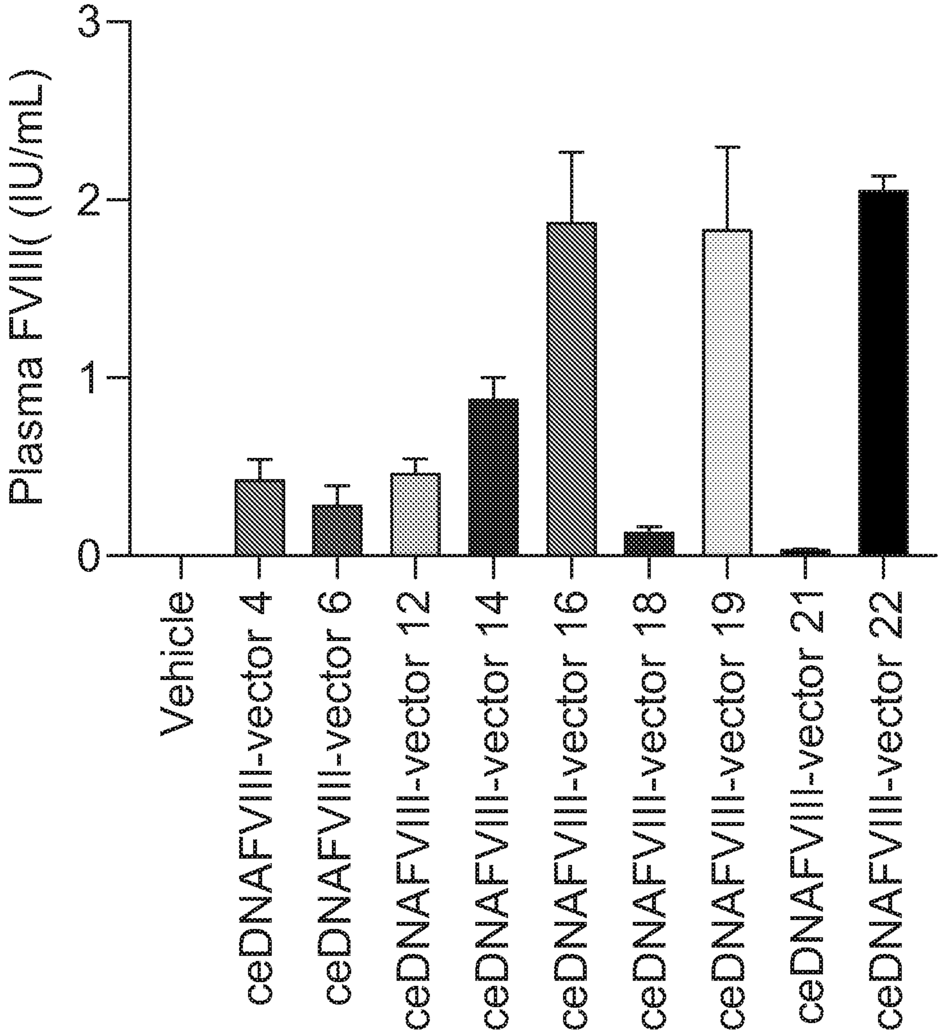
FIG. 12 is a graph that depicts plasma FVIII concentration (IU/ml) 3 days after hydrodynamic delivery of various ceDNA vectors expressing FVIII (ceDNAFVIII-vector 4, ceDNAFVIII-vector 6, ceDNAFVIII-vector 12, ceDNAFVIII-vector 14, ceDNAFVIII-vector 16, ceDNAFVIII-vector 18, ceDNAFVIII-vector 19, ceDNAFVIII-vector 21, ceDNAFVIII-vector 22). ceDNAFVIII-vector 16, ceDNAFVIII-vector 19 and ceDNAFVIII-vector 21 showed the highest plasma Factor VIII concentration after 3 days. Vehicle only was used as control.
Figure 13:
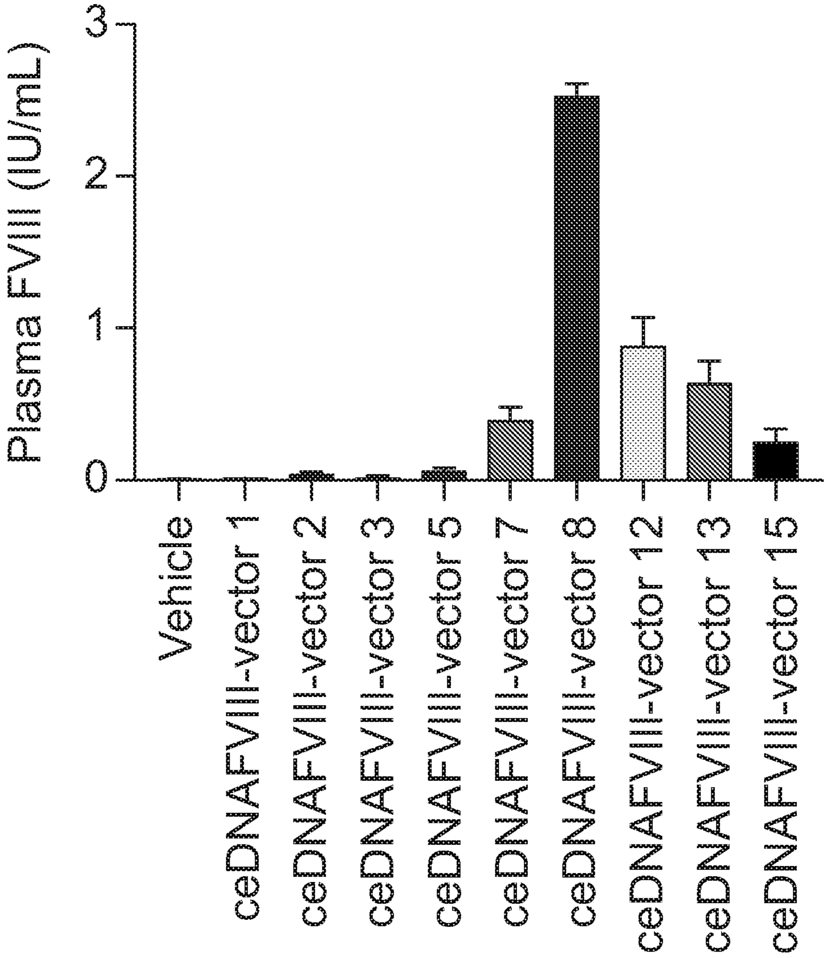
FIG. 13 is a graph that depicts plasma FVIII concentration (IU/ml) 3 days after hydrodynamic delivery of various ceDNA vectors expressing FVIII (ceDNAFVIII-vector 1, ceDNAFVIII-vector 2, ceDNAFVIII-vector 3, ceDNAFVIII-vector 5, ceDNAFVIII-vector 7, ceDNAFVIII-vector 8, ceDNAFVIII-vector 12, ceDNAFVIII-vector 13, ceDNAFVIII-vector 15). ceDNAFVIII-vector 8 showed the highest plasma Factor VIII concentration after 3 days. Vehicle only was used as control.
Figure 14:
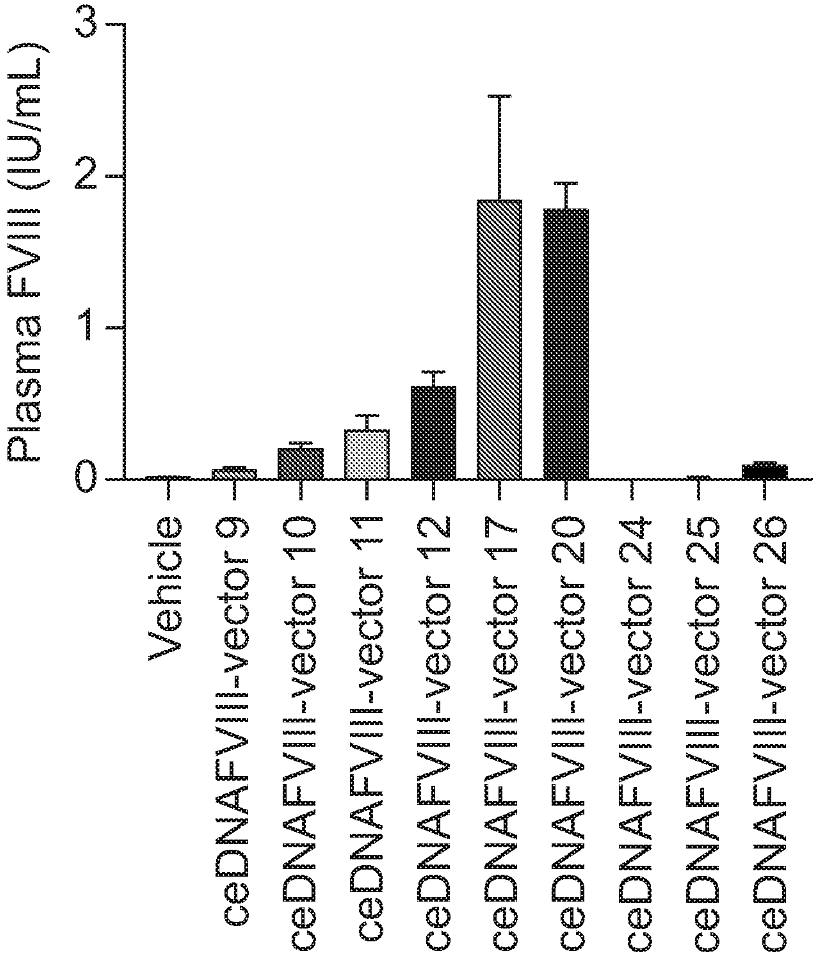
FIG. 14 is a graph that depicts plasma FVIII concentration (IU/ml) 3 days after hydrodynamic delivery of various ceDNA vectors expressing FVIII (ceDNAFVIII-vector 9, ceDNAFVIII-vector 10, ceDNAFVIII-vector 11, ceDNAFVIII-vector 12, ceDNAFVIII-vector 17, ceDNAFVIII-vector 20, ceDNAFVIII-vector 24, ceDNAFVIII-vector 25, ceDNAFVIII-vector 26). ceDNAFVIII-vector 17 and ceDNAFVIII-vector 20 showed the highest plasma Factor VIII concentration after 3 days. Vehicle only was used as control.
Figure 15:
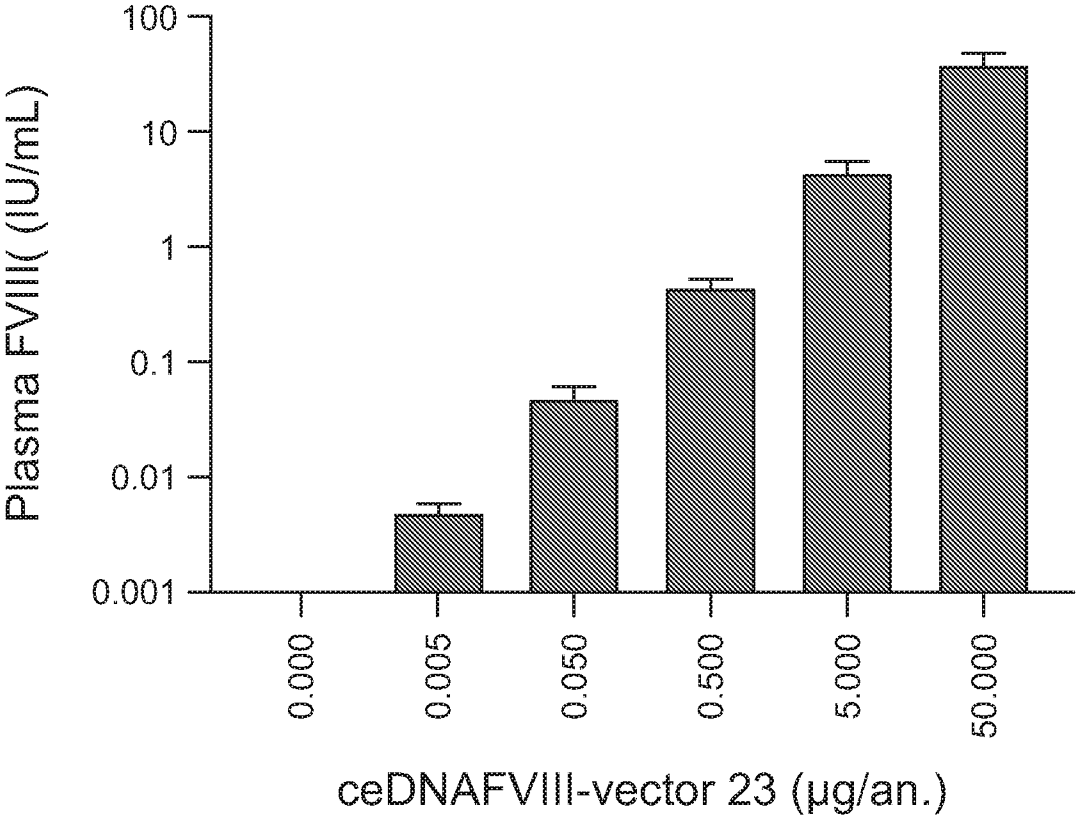
FIG. 15 is a graph that depicts plasma FVIII concentration (IU/ml) 1 day after hydrodynamic delivery of escalating doses of ceDNAFVIII-vector 23 (0.005 μg-50 μg).

Results:

The results shown in FIGS. 12-15 show the effect of the various ceDNA vectors expressing FVIII on serum FVIII levels, where detection of FVIII in the serum indicated that the ceDNA vector was able to express FVIII after injection. FIG. 12 is a graph that depicts plasma FVIII concentration (IU/ml) 3 days after hydrodynamic delivery of various ceDNA vectors expressing FVIII (ceDNAFVIII-vector 4, ceDNAFVIII-vector 6, ceDNAFVIII-vector 12, ceDNAFVIII-vector 14, ceDNAFVIII-vector 16, ceDNAFVIII-vector 18, ceDNAFVIII-vector 19, ceDNAFVIII-vector 21, ceDNAFVIII-vector 22). ceDNAFVIII-vector 16, ceDNAFVIII-vector 19 and ceDNAFVIII-vector 21 showed the highest plasma Factor VIII concentration after 3 days. Vehicle only was used as control. FIG. 13 is a graph that depicts plasma FVIII concentration (IU/ml) 3 days after hydrodynamic delivery of various ceDNA vectors expressing FVIII (ceDNAFVIII-vector 1, ceDNAFVIII-vector 2, ceDNAFVIII-vector 3, ceDNAFVIII-vector 5, ceDNAFVIII-vector 7, ceDNAFVIII-vector 8, ceDNAFVIII-vector 12, ceDNAFVIII-vector 13, ceDNAFVIII-vector 15). ceDNAFVIII-vector 8 showed the highest plasma Factor VIII concentration after 3 days. Vehicle only was used as control. FIG. 14 is a graph that depicts plasma FVIII concentration (IU/ml) 3 days after hydrodynamic delivery of various ceDNA vectors expressing FVIII (ceDNAFVIII-vector 9, ceDNAFVIII-vector 10, ceDNAFVIII-vector 11, ceDNAFVIII-vector 12, ceDNAFVIII-vector 17, ceDNAFVIII-vector 20, ceDNAFVIII-vector 24, ceDNAFVIII-vector 25, ceDNAFVIII-vector 26). ceDNAFVIII-vector 17 and ceDNAFVIII-vector 20 showed the highest plasma Factor VIII concentration after 3 days. Vehicle only was used as control. FIG. 15 is a graph that depicts plasma FVIII concentration (IU/ml) 1 day after hydrodynamic delivery of escalating doses of ceDNAFVIII-vector 23 (0.005-50 μg). As shown in FIG. 15, plasma FVIII increased in a dose-dependent manner with increasing dosage of ceDNAFVIII-vector 23. Vehicle only was used as control.

Example 14: FVIII Expression after LNP:ceDNA Delivery in Combination with a Kinase Inhibitor in Male CD-1 Mice LNP:ceDNA vectors were prepared as described in Example 6. The effect of ceDNA:lipid formulations were tested in male CD-1 mice. The vehicle for dosing and inhibitor preparation was 0.5% methylcellulose.

LNP:ceDNA test material (ceDNAFVIII-vector 23) was administered as follows:

| Group No. | Animals per Group | Treatment | Dose Level (mg/kg | Dose Volume (mL/kg) | Treatment Regimen, IV | Terminal Time Point |
|---|---|---|---|---|---|---|
| 1 | 5 | PBS | 2.0 | 5 | Once on Day 0 | Day 7 |
| 2 | 5 | ceDNAFVIII-vector 23 | 2.0 | | | |
| Test article storage (stock formulations): Test article for Groups 1-2 was supplied in a concentrated stock (1.0 mg/mL) and stored nominally −80° C. until use. Do not vortex or centrifuge formulations. Housing: Group housed in clear polycarbonate cages with contact bedding in a ventilated rack in a procedure room. | | | Comments: Residual TA, both diluted and stock, was stored at nominally 4° C. until dosing is complete, then discarded. Chow/Water: Mouse Diet 5058 and filtered tap water acidified with 1N HCl to a targeted pH of 2.5-3.0 were provided to the animals ad libitum. | | | |

No. = Number;
IV = intravenous;
ROA = route of administration

Blood (interim and terminal) samples were collected as set forth below:

| Group Number | Sample Collection Times<br>Whole Blood (orbital) | Terminal Whole Blood (cardiac) |
|---|---|---|
| | Sodium Citrate Plasma | |
| 1-2 | Day 3 | Day 7 |
| Volume/ Portion | 120 A whole blood | MOV |
| Processing/ Storage | whole blood was added to tube pre-coated with 13.33 pi of 3.2% sodium citrate and kept ambient until processed<br>One (1) aliquot of plasma<br>Frozen at nominally −70° C. | 600 μ 1_, whole blood was added to tube pre-coated with 66.6 1. μL of 3.2% sodium citrate and kept ambient until processed<br>Two (2) aliquots of plasma<br>Frozen at nominally −70° C. |

Tissue samples were collected as set forth below:

| Group Number | Sample Collection Times<br>Liver |
|---|---|
| 1-2 | On Day 7 |
| Volume/Portion | Whole organ, divided |
| Processing | Whole organ weight 4 × = 25-50 mg pieces weighed and snap frozen individually (Lake Pharma) |
| Storage | Frozen at nominally −70° C. |

Study Details are Provided as Follows:

Species (number, sex, age): CD-1 mice (N=10+2 spare, male, 4 weeks of age at arrival) from Charles River Laboratories.

Cage Side Observations: Cage side observations were performed daily.

Clinical Observations: Clinical observations were performed about 1, 5-6 and 24 hours post Day 0 Test Material dose.

Body Weights: Body weight for all animals was recorded on Days 0, 1, 2, 3, and 7, including prior to euthanasia.

Test Material Dose Formulation: Test articles were supplied in a concentration stock. Stock diluted with PBS immediately prior to use. Prepared materials were stored at −4° C. (or on wet ice) if dosing was not performed immediately.

Dose Administration: Test articles were dosed at 5 mL/kg on Day 0 for Groups 1-2 by intravenous administration via lateral tail vein.

Blood Collection: All animals in Groups 1-2 had interim blood collected on Day 3 per blood collection table above. After each collection animals received 0.5-1.0 mL lactated Ringer's, subcutaneously. For plasma collections, whole blood was collected into non-coated Eppendorf style tubes via orbital sinus puncture under anesthesia per facility SOPS Immediately 120 μL was withdrawn and placed into tubes containing 13.33 pl of 3.2% sodium citrate. Blood was gently mixed and maintained ambient until processed. Whole blood samples were centrifuged at 2,000 g for 15 minutes under ambient conditions (20-25° C.). Plasma samples were withdrawn avoiding the cell pack. One (1) aliquot was made and any clotting in the whole blood sample or hemolysis in the plasma will be noted.

Anesthesia Recovery: Animals were monitored continuously while under anesthesia, during recovery and until mobile.

Terminal Blood Collection: On Day 7, animals were euthanized by $CO_2$ asphyxiation followed by thoracotomy and exsanguination. Maximum obtainable blood volume was collected by cardiac puncture and processed to plasma. For plasma collections, whole blood was collected by syringe and 600 μL placed immediately tubes containing 66.66 μL, of 3.2% sodium citrate. Blood was gently mixed and maintained ambient until processed. Whole blood samples were centrifuged at 2,000 g for 15 minutes under ambient conditions (20-25° C.). Plasma samples were withdrawn avoiding the cell pack and two (2) aliquots made. Any clotting in the whole blood sample or hemolysis in the plasma was noted.

Perfusion: Following exsanguination, all animals underwent cardiac perfusion with saline. In brief, whole body intracardiac perfusion was performed by inserting 23/21-gauge needle attached to 10 mL syringe containing saline into the lumen of the left ventricle for perfusion. The right atrium was incised to provide a drainage outlet for perfusate. Gentle and steady pressure was applied to the plunger to perfuse the animal after the needle has been positioned in the heart. Adequate flow of the flushing solution was ensured until the exiting perfusate flows clear (free of visible blood) indicating that the flushing solution had saturated the body and the procedure was complete.

Tissue Collection: Terminal tissues were collected from moribund animals that were euthanized prior to their scheduled time point. If possible, tissues were collected and stored from animals that were found dead.

After euthanasia and perfusion, the liver was harvested. From the liver, four (4) 25-50 mg sections were collected and weighed. Sections were snap frozen individually, stored at nominally −70° C. until shipped.

Figure 16:
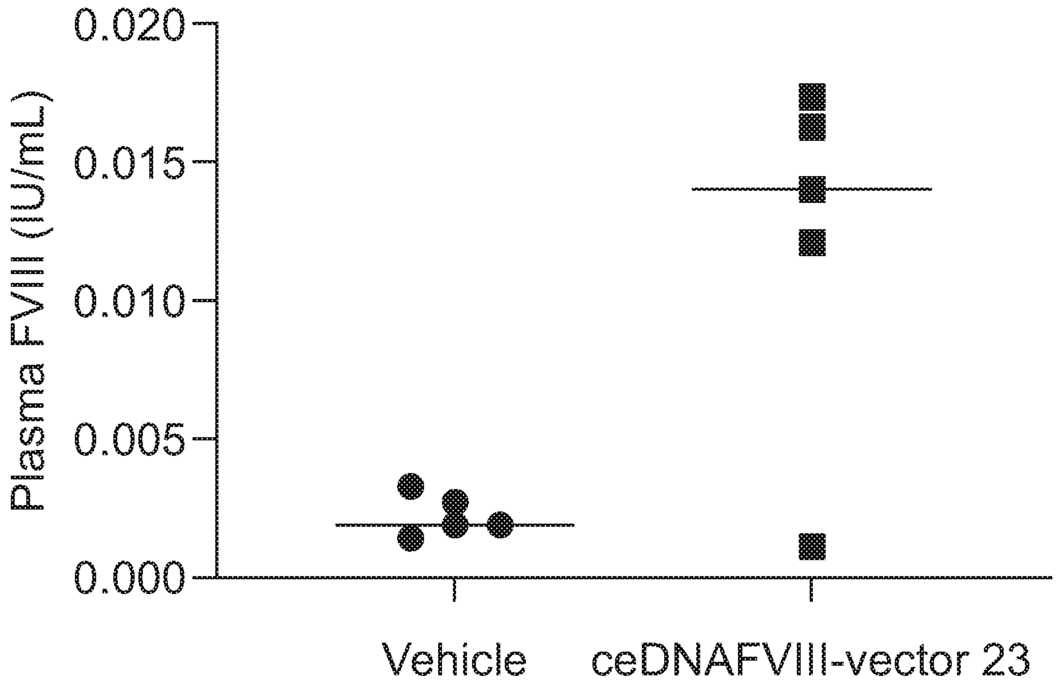
FIG. 16 is a graph that depicts plasma FVIII concentration (IU/mL) at 7 days after hydrodynamic delivery of the LNP:ceDNAFVIII-vector 23 test article.

Results: FIG. 16 shows plasma FVIII concentration (IU/mL) at 7 days after administration of the LNP:ceDNAFVIII-vector 23 test article. As shown in FIG. 16, FVIII was readily detected in plasma samples from mice treated with the LNP:ceDNAFVIII-vector 23 test article, but was not observed in mice treated with vehicle only.

REFERENCES

All publications and references, including but not limited to patents and patent applications, cited in this specification and Examples herein are incorporated by reference in their entirety as if each individual publication or reference were specifically and individually indicated to be incorporated by reference herein as being fully set forth. Any patent application to which this application claims priority is also incorporated by reference herein in the manner described above for publications and references.

SEQUENCE LISTING (398 sequences)

SEQ ID NO: 1 - DNA, 141 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 2 - DNA, 141 bp, Artificial Sequence
  Description of Artificial Sequence: Synthetic polynucleotide
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 3 - DNA, 130 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgcccgggcggcctcagtgagcgagcgagcgcgcagctgcctgcagg

SEQ ID NO: 4 - DNA, 130 bp, Artificial Sequence
  Description of Artificial Sequence: Synthetic polynucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcct

SEQ ID NO: 5 - DNA, 143 bp, Artificial Sequence
  Description of Artificial Sequence: Synthetic polynucleotide
ttgcccactccctctctgcgcgctcgctcgctcggtggggcctgcggaccaaaggtccgcagacggcagaggtctcctctgccggccccaccgagcgagcgacgcgcgcagagagggagtgggcaactccatcactagggtaa

SEQ ID NO: 6 - DNA, 144 bp, Artificial Sequence
  Description of Artificial Sequence: Synthetic polynucleotide
ttggccactccctctatgcgcactcgctcgctcggtggggcctggcgaccaaaggtcgccagacggacgtgggtttccacgtccggccccaccgagcgagcgagtgcgcatagagggagtggccaactccatcactagaggtat

SEQ ID NO: 7 - DNA, 127 bp, Artificial Sequence
  Description of Artificial Sequence: Synthetic polynucleotide
ttggccactccctctatgcgcgctcgctcactcactcggccctggagaccaaaggtctccagactgccggcctctggccggcagggccgagtgagtgagcgagcgcgcatagagggagtggccaact

SEQ ID NO: 8 - DNA, 166 bp, Artificial Sequence
  Description of Artificial Sequence: Synthetic polynucleotide
tcccccctgtcgcgttcgctcgctcgctggctcgtttgggggggcgacggccagagggccgtcgtctggcagctctttgagctgccacccccccaaacgagccagcgagcgagcgaacgcgacaggggggagagtgccacactctcaagcaagggggttttgtaag

SEQ ID NO: 9 - DNA, 144 bp, Artificial Sequence
  Description of Artificial Sequence: Synthetic polynucleotide
ttgcccactccctctaatgcgcgctcgctcgctcggtggggcctgcggaccaaaggtccgcagacggcagaggtctcctctgccggccccaccgagcgagcgagcgcgcatagagggagtgggcaactccatcactaggggtat

SEQ ID NO: 10 - DNA, 143 bp, Artificial Sequence
  Description of Artificial Sequence: Synthetic polynucleotide
ttaccctagtgatggagttgcccactccctctctgcgcgcgtcgctcgctcggtggggccggcagaggagacctctgccgtctgcggacctttggtccgcaggccccaccgagcgagcgagcgcgcagagagggagtgggcaa

SEQ ID NO: 11 - DNA, 144 bp, Artificial Sequence
  Description of Artificial Sequence: Synthetic polynucleotide
atacctctagtgatggagttggccactccctctatgcgcactcgctcgctcggtggggccggacgtggaaacccacgtccgtctggcgacctttggtcgccaggccccaccgagcgagcgagtgcgcatagagggagtggccaa

SEQ ID NO: 12 - DNA, 127 bp, Artificial Sequence
  Description of Artificial Sequence: Synthetic polynucleotide
agttggccacattagctatgcgcgctcgctcactcactcggccctggagaccaaaggtctccagactgccggcctctggccggcagggccgagtgagtgagcgagcgcgcatagagggagtggccaa

SEQ ID NO: 13 - DNA, 166 bp, Artificial Sequence
  Description of Artificial Sequence: Synthetic polynucleotide
cttacaaaacccccttgcttgagagtgtggcactctcccccctgtcgcgttcgctcgctcgctggctcgtttgggggggtggcagctcaaagagctgccagacgacggccctctggccgtcgcccccccaaacgagccagcgagcgagcgaacgcgacagggggga

SEQ ID NO: 14 - DNA, 144 bp, Artificial Sequence
  Description of Artificial Sequence: Synthetic polynucleotide
atacccctagtgatggagttgcccactccctctatgcgcgctcgctcgctcggtggggccggcagaggagacctctgccgtctgcggacctttggtccgcaggccccaccgagcgagcgagcgcgcattagagggagtgggcaa

SEQ ID NO: 15 - DNA, 120 bp, Artificial Sequence
  Description of Artificial Sequence: Synthetic polynucleotide
aggaacccctagtgatggagttggccactccctctctgcgcgctcgctcgctcactgaggcgcacgcccgggtttcccgggcggcctcagtgagcgagcgagcgcgcagctgcctgcagg

SEQ ID NO: 16 - DNA, 122 bp, Artificial Sequence
  Description of Artificial Sequence: Synthetic polynucleotide
aggaacccctagtgatggagttggccactccctctctgcgcgctcgctcgctcactgaggccgacgcccgggctttgcccgggcggcctcagtgagcgagcgagcgcgcagctgcctgcagg

SEQ ID NO: 17 - DNA, 129 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgcccgggcgcctcagtgagcgagcgagcgcgcagctgcctgcagg

SEQ ID NO: 18 - DNA, 101 bp, Artificial Sequence
  Description of Artificial Sequence: Synthetic polynucleotide
aggaacccctagtgatggagttggccactccctctctgcgcgctcgctcgctcactgaggctttgcctcagtgagcgagcgagcgcgcagctgcctgcagg

SEQ ID NO: 19 - DNA, 139 bp, Artificial Sequence
  Description of Artificial Sequence: Synthetic polynucleotide
aggaacccctagtgatggagttggccactccctctctgcgcgctcgctcgctcactgaggccgggcgacaaagtcgcccgacgcccgggctttgcccgggcggcctcagtgagcgagcgagcgcgcagctgcctgcagg

SEQ ID NO: 20 - DNA, 137 bp, Artificial Sequence
  Description of Artificial Sequence: Synthetic polynucleotide
aggaacccctagtgatggagttggccactccctctctgcgcgctcgctcgctcactgaggccgggcgaaaatcgcccgacgcccgggctttgcccgggcggcctcagtgagcgagcgagcgcgcagctgcctgcagg

SEQ ID NO: 21 - DNA, 135 bp, Artificial Sequence
  Description of Artificial Sequence: Synthetic polynucleotide
aggaacccctagtgatggagttggccactccctctctgcgcgctcgctcgctcactgaggccgggcgaaacgcccgacgcccgggctttgcccgggcggcctcagtgagcgagcgagcgcgcagctgcctgcagg

SEQ ID NO: 22 - DNA, 133 bp, Artificial Sequence
  Description of Artificial Sequence: Synthetic polynucleotide
aggaacccctagtgatggagttggccactccctctctgcgcgctcgctcgctcactgaggccgggcaaagcccgacgcccgggctttgcccgggcggcctcagtgagcgagcgagcgcgcagctgcctgcagg

SEQ ID NO: 23 - DNA, 139 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgcccgggtttcccgggcggcctcagtgagcgagcgagcgcgcagctgcctgcagg

SEQ ID NO: 24 - DNA, 137 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgcccggtttccgggcggcctcagtgagcgagcgagcgcgcagctgcctgcagg

SEQ ID NO: 25 - DNA, 135 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgcccgtttcgggcggcctcagtgagcgagcgagcgcgcagctgcctgcagg

SEQ ID NO: 26 - DNA, 133 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgccctttgggcggcctcagtgagcgagcgagcgcgcagctgcctgcagg

SEQ ID NO: 27 - DNA, 131 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgcctttggcggcctcagtgagcgagcgagcgcgcagctgcctgcagg

SEQ ID NO: 28 - DNA, 129 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgctttgcggcctcagtgagcgagcgagcgcgcagctgcctgcagg

SEQ ID NO: 29 - DNA, 127 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacgtttcggcctcagtgagcgagcgagcgcgcagctgcctgcagg

SEQ ID NO: 30 - DNA, 122 bp, Artificial Sequence
  Description of Artificial Sequence: Synthetic polynucleotide
aggaacccctagtgatggagttggccactccctctctgcgcgctcgctcgctcactgaggccgggcgaccaaaggtcgcccgacggcctcagtgagcgagcgagcgcgcagctgcctgcagg

SEQ ID NO: 31 - DNA, 130 bp, Artificial Sequence; identical to SEQ ID NO: 3
  Description of Artificial Sequence: Synthetic polynucleotide

SEQ ID NO: 32 - DNA, 120 bp, Artificial Sequence
  Description of Artificial Sequence: Synthetic polynucleotide
cctgcaggcagctgcgcgctcgctcgctcactgaggccgcccgggaaacccgggcgtgcgcctcagtgagcgagcgagcgcgcagagagggagtggccaactccatcactaggggttcct

SEQ ID NO: 33 - DNA, 122 bp, Artificial Sequence
  Description of Artificial Sequence: Synthetic polynucleotide
cctgcaggcagctgcgcgctcgctcgctcactgaggccgtcgggcgacctttggtcgcccggcctcagtgagcgagcgagcgcgcagagagggagtggccaactccatcactaggggttcct

SEQ ID NO: 34 - DNA, 122 bp, Artificial Sequence
  Description of Artificial Sequence: Synthetic polynucleotide
cctgcaggcagctgcgcgctcgctcgctcactgaggccgcccgggcaaagcccgggcgtcggcctcagtgagcgagcgagcgcgcagagagggagtggccaactccatcactaggggttcct

SEQ ID NO: 35 - DNA, 129 bp, Artificial Sequence
  Description of Artificial Sequence: Synthetic polynucleotide
cctgcaggcagctgcgcgctcgctcgctcactgaggcgcccgggcgtcgggcgacctttggtcgcccggcctcagtgagcgagcgagcgcgcagagagggagtggccaactccatcactaggggttcct

SEQ ID NO: 36 - DNA, 101 bp, Artificial Sequence
  Description of Artificial Sequence: Synthetic polynucleotide
cctgcaggcagctgcgcgctcgctcgctcactgaggcaaagcctcagtgagcgagcgagcgcgcagagagggagtggccaactccatcactaggggttcct

SEQ ID NO: 37 - DNA, 139 bp, Artificial Sequence
  Description of Artificial Sequence: Synthetic polynucleotide
cctgcaggcagctgcgcgctcgctcgctcactgaggccgcccgggcaaagcccgggcgtcgggcgactttgtcgcccggcctcagtgagcgagcgagcgcgcagagagggagtggccaactccatcactaggggttcct

SEQ ID NO: 38 - DNA, 137 bp, Artificial Sequence
  Description of Artificial Sequence: Synthetic polynucleotide
cctgcaggcagctgcgcgctcgctcgctcactgaggccgcccgggcaaagcccgggcgtcgggcgattttcgcccggcctcagtgagcgagcgagcgcgcagagagggagtggccaactccatcactaggggttcct

SEQ ID NO: 39 - DNA, 135 bp, Artificial Sequence
  Description of Artificial Sequence: Synthetic polynucleotide
cctgcaggcagctgcgcgctcgctcgctcactgaggccgcccgggcaaagcccgggcgtcgggcgtttcgcccggcctcagtgagcgagcgagcgcgcagagagggagtggccaactccatcactaggggttcct

SEQ ID NO: 40 - DNA, 133 bp, Artificial Sequence
  Description of Artificial Sequence: Synthetic polynucleotide
cctgcaggcagctgcgcgctcgctcgctcactgaggccgcccgggcaaagcccgggcgtcgggctttgcccggcctcagtgagcgagcgagcgcgcagagagggagtggccaactccatcactaggggttcct

SEQ ID NO: 41 - DNA, 139 bp, Artificial Sequence
  Description of Artificial Sequence: Synthetic polynucleotide
cctgcaggcagctgcgcgctcgctcgctcactgaggccgcccgggaaacccgggcgtcgggcgacctttggtcgcccggcctcagtgagcgagcgagcgcgcagagagggagtggccaactccatcactaggggttcct

SEQ ID NO: 42 - DNA, 137 bp, Artificial Sequence
  Description of Artificial Sequence: Synthetic polynucleotide
cctgcaggcagctgcgcgctcgctcgctcactgaggccgcccggaaaccgggcgtcgggcgacctttggtcgcccggcctcagtgagcgagcgagcgcgcagagagggagtggccaactccatcactaggggttcct

SEQ ID NO: 43 - DNA, 135 bp, Artificial Sequence
  Description of Artificial Sequence: Synthetic polynucleotide
cctgcaggcagctgcgcgctcgctcgctcactgaggccgcccgaaacgggcgtcgggcgacctttggtcgcccggcctcagtgagcgagcgagcgcgcagagagggagtggccaactccatcactaggggttcct

SEQ ID NO: 44 - DNA, 133 bp, Artificial Sequence
  Description of Artificial Sequence: Synthetic polynucleotide
cctgcaggcagctgcgcgctcgctcgctcactgaggccgcccaaagggcgtcgggcgacctttggtcgcccggcctcagtgagcgagcgagcgcgcagagagggagtggccaactccatcactaggggttcct

SEQ ID NO: 45 - DNA, 131 bp, Artificial Sequence
  Description of Artificial Sequence: Synthetic polynucleotide
cctgcaggcagctgcgcgctcgctcgctcactgaggccgccaaaggcgtcgggcgacctttggtcgcccggcctcagtgagcgagcgagcgcgcagagagggagtggccaactccatcactaggggttcct

SEQ ID NO: 46 - DNA, 129 bp, Artificial Sequence
  Description of Artificial Sequence: Synthetic polynucleotide
cctgcaggcagctgcgcgctcgctcgctcactgaggccgcaaagcgtcgggcgacctttggtcgcccggcctcagtgagcgagcgagcgcgcagagagggagtggccaactccatcactaggggttcct

SEQ ID NO: 47 - DNA, 127 bp, Artificial Sequence
  Description of Artificial Sequence: Synthetic polynucleotide
cctgcaggcagctgcgcgctcgctcgctcactgaggccgaaacgtcgggcgacctttggtcgcccggcctcagtgagcgagcgagcgcgcagagagggagtggccaactccatcactaggggttcct

SEQ ID NO: 48 - DNA, 122 bp, Artificial Sequence; identical to SEQ ID NO: 30
  Description of Artificial Sequence: Synthetic polynucleotide

SEQ ID NO: 49 - DNA, 12 bp, Artificial Sequence
  Description of Artificial Sequence: Synthetic oligonucleotide
cgatcgttcgat

SEQ ID NO: 50 - DNA, 12 bp, Artificial Sequence
  Description of Artificial Sequence: Synthetic oligonucleotide
atcgaaccatcg

SEQ ID NO: 51 - DNA, 12 bp, Artificial Sequence
  Description of Artificial Sequence: Synthetic oligonucleotide
atcgaacgatcg

SEQ ID NO: 52 - DNA, 165 bp, Artificial Sequence
  Description of Artificial Sequence: Synthetic polynucleotide
aggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 53 - DNA, 140 bp, Artificial Sequence
  Description of Artificial Sequence: Synthetic polynucleotide
cccctagtgatggagttggccactccctctctgcgcgctcgctcgctcactgaggccgcccgggcaaagcccgggcgtcgggcgacctttggtcgcccggcctcagtgagcgagcgagcgcgcagagagatcactagggg

SEQ ID NO: 54 - DNA, 91 bp, Artificial Sequence
  Description of Artificial Sequence: Synthetic oligonucleotide
gcgcgctcgctcgctcactgaggccgcccgggcaaagcccgggcgtcgggcgacctttggtcgcccggcctcagtgagcgagcgagcgcgc

SEQ ID NO: 55 - DNA, 91 bp, Artificial Sequence
  Description of Artificial Sequence: Synthetic oligonucleotide
gcgcgctcgctcgctcactgaggccgggcgaccaaaggtcgcccgacgcccgggctttgcccgggcggcctcagtgagcgagcgagcgcgc

SEQ ID NO: 56 - DNA, 1662 bp, Artificial Sequence
  Description of Artificial Sequence: Synthetic polynucleotide
gccgccaccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtaa

SEQ ID NO: 57 - protein, 453 aa, Artificial Sequence
  Description of Artificial Sequence: Synthetic polypeptide
  MOD_RES (1)..(1): Any amino acid
XVQLVESGGGVVQPGRSLRLSCAASGFAFSSYGMHWVRQAPGKGLEWVAVIWFDGTKKYYTDSVKGRFTISRDNSKNTLYLQMNTLRAEDTAVYYCARDRGIGARRGPYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 58 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 59 - DNA, 1310 bp, Artificial Sequence
  Description of Artificial Sequence: Synthetic polynucleotide
ggagccgagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaa

SEQ ID NO: 60 - DNA, 16 bp, Artificial Sequence
  Description of Artificial Sequence: Synthetic oligonucleotide
gcgcgctcgctcgctc

SEQ ID NO: 61 - DNA, 6 bp, Artificial Sequence
  Description of Artificial Sequence: Synthetic oligonucleotide
ggttga

SEQ ID NO: 62 - DNA, 4 bp, Artificial Sequence
  Description of Artificial Sequence: Synthetic oligonucleotide
agtt

SEQ ID NO: 63 - DNA, 6 bp, Artificial Sequence
  Description of Artificial Sequence: Synthetic oligonucleotide
ggttgg

SEQ ID NO: 64 - DNA, 6 bp, Artificial Sequence
  Description of Artificial Sequence: Synthetic oligonucleotide
agttgg

SEQ ID NO: 65 - DNA, 6 bp, Artificial Sequence
  Description of Artificial Sequence: Synthetic oligonucleotide
agttga

SEQ ID NO: 66 - DNA, 6 bp, Artificial Sequence
  Description of Artificial Sequence: Synthetic oligonucleotide
rrttrr

SEQ ID NO: 67 - DNA, 581 bp, Artificial Sequence
  Description of Artificial Sequence: Synthetic polynucleotide
gagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtc

SEQ ID NO: 68 - DNA, 225 bp, Artificial Sequence
  Description of Artificial Sequence: Synthetic polynucleotide
tgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggc

SEQ ID NO: 69 - DNA, 8 bp, Artificial Sequence
  Description of Artificial Sequence: Synthetic oligonucleotide
actgaggc

SEQ ID NO: 70 - DNA, 8 bp, Artificial Sequence
  Description of Artificial Sequence: Synthetic oligonucleotide
gcctcagt

SEQ ID NO: 71 - DNA, 16 bp, Artificial Sequence
  Description of Artificial Sequence: Synthetic oligonucleotide
gagcgagcgagcgcgc

SEQ ID NO: 72 - DNA, 1923 bp, Artificial Sequence
  Description of Artificial Sequence: Synthetic polynucleotide
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttttagccttcttctttttcctacagctcctgggcaacgtgctggttattgtgctgtctcatcatttgtcgacagaattcctcgaagatccgaaggggttcaagcttggcattccggtactgttggtaaagcca

SEQ ID NO: 73 - DNA, 1272 bp, Artificial Sequence
  Description of Artificial Sequence: Synthetic polynucleotide
aggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaggtaccggatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactga

SEQ ID NO: 74 - DNA, 1177 bp, Artificial Sequence
  Description of Artificial Sequence: Synthetic polynucleotide
ggctcagaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaggtaccggatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagt

SEQ ID NO: 75 - DNA, 547 bp, Artificial Sequence
  Description of Artificial Sequence: Synthetic polynucleotide
ccctaaaatgggcaaacattgcaagcagcaaacagcaaacacacagccctccctgcctgctgaccttggagctggggcagaggtcagagacctctctgggcccatgccacctccaacatccactcgaccccttggaatttttcggtggagaggagcagaggttgtcctggcgtggtttaggtagtgtgagaggggaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactga

SEQ ID NO: 76 - DNA, 556 bp, Artificial Sequence
  Description of Artificial Sequence: Synthetic polynucleotide
ccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagaggggaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacactcgagggccctgtctcctcagcttcaggcaccaccactgacctgggacagtgaatccggacatcgattctaaggtaaatataaaatttttaagtgtataatttgttaaactactgattctaattgtttctctcttttagattccaacctttggaactga

SEQ ID NO: 77 - DNA, 1179 bp, Artificial Sequence
  Description of Artificial Sequence: Synthetic polynucleotide
ggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggtctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 78 - DNA, 141 bp, Artificial Sequence
  Description of Artificial Sequence: Synthetic polynucleotide
aataaacgataacgccgttggtggcgtgaggcatgtaaaaggttacatcattatcttgttcgccatccggttggtataaatagacgttcatgttggtttttgtttcagttgcaagttggctgcggcgcgcgcagcaccttt

SEQ ID NO: 79 - DNA, 317 bp, Artificial Sequence
  Description of Artificial Sequence: Synthetic polynucleotide
ggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaa

SEQ ID NO: 80 - DNA, 241 bp, Artificial Sequence
  Description of Artificial Sequence: Synthetic polynucleotide
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggac

SEQ ID NO: 81 - DNA, 215 bp, Artificial Sequence
  Description of Artificial Sequence: Synthetic polynucleotide
gaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcgtataagaactgtatgagaccac

SEQ ID NO: 82 - DNA, 546 bp, Artificial Sequence
  Description of Artificial Sequence: Synthetic polynucleotide
ccctaaaatgggcaaacattgcaagcagcaaacagcaaacacacagccctccctgcctgctgaccttggagctggggcagaggtcagagacctctctgggcccatgccacctccaacatccactcgaccccttggaatttttcggtggagaggagcagaggttgtcctggcgtggtttaggtagtgtgagaggggaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactg

SEQ ID NO: 83 - DNA, 576 bp, Artificial Sequence
  Description of Artificial Sequence: Synthetic polynucleotide
tagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcag

SEQ ID NO: 84 - DNA, 150 bp, Artificial Sequence
  Description of Artificial Sequence: Synthetic polynucleotide
ataaacgataacgccgttggtggcgtgaggcatgtaaaaggttacatcattatcttgttcgccatccggttggtataaatagacgttcatgttggtttttgtttcagttgcaagttggctgcggcgcgcgcagcacctttgcggccatct

SEQ ID NO: 85 - DNA, 1313 bp, Artificial Sequence
  Description of Artificial Sequence: Synthetic polynucleotide
ggagccgagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaa

SEQ ID NO: 86 - DNA, 213 bp, Artificial Sequence
  Description of Artificial Sequence: Synthetic polynucleotide
taagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 87 - protein, 7 aa, Artificial Sequence
  Description of Artificial Sequence: Synthetic peptide
PKKKRKV

SEQ ID NO: 88 - protein, 19 aa, Artificial Sequence
  Description of Artificial Sequence: Synthetic peptide
MDWTWRILFLVAAATGAHS

SEQ ID NO: 89 - protein, 19 aa, Artificial Sequence
  Description of Artificial Sequence: Synthetic peptide
MLPSQLIGFLLLWVPASRG

SEQ ID NO: 90 - protein, 7 aa, Simian virus 40
PKKKRKV

SEQ ID NO: 91 - DNA, 21 bp, Simian virus 40
cccaagaagaagaggaaggtg

SEQ ID NO: 92 - protein, 16 aa, Unknown
  Description of Unknown: Nucleoplasmin bipartite NLS sequence
KRPAATKKAGQAKKKK

SEQ ID NO: 93 - protein, 9 aa, Unknown
  Description of Unknown: C-myc NLS sequence
PAAKRVKLD

SEQ ID NO: 94 - protein, 11 aa, Unknown
  Description of Unknown: C-myc NLS sequence
RQRRNELKRSP

SEQ ID NO: 95 - protein, 38 aa, Homo sapiens
NQSSNFGPMKGGNFGGRSSGPYGGGGQYFAKPRNQGGY

SEQ ID NO: 96 - protein, 42 aa, Unknown
  Description of Unknown: IBB domain from importin-alpha sequence
RMRIZFKNKGKDTAELRRRRVEVSVELRKAKKDEQILKRRNV

SEQ ID NO: 97 - protein, 8 aa, Unknown
  Description of Unknown: Myoma T protein sequence
VSRKRPRP

SEQ ID NO: 98 - protein, 8 aa, Unknown
  Description of Unknown: Myoma T protein sequence
PPKKARED

SEQ ID NO: 99 - protein, 8 aa, Homo sapiens
PQPKKKPL

SEQ ID NO: 100 - protein, 12 aa, Mus musculus
SALIKKKKKMAP

SEQ ID NO: 101 - DNA, 70 bp, Artificial Sequence
  Description of Artificial Sequence: Synthetic oligonucleotide
gcgcgctcgctcgctcactgaggccgcccgggaaacccgggcgtgcgcctcagtgagcgagcgagcgcgc

SEQ ID NO: 102 - DNA, 70 bp, Artificial Sequence
  Description of Artificial Sequence: Synthetic oligonucleotide
gcgcgctcgctcgctcactgaggcgcacgcccgggtttcccgggcggcctcagtgagcgagcgagcgcgc

SEQ ID NO: 103 - DNA, 72 bp, Artificial Sequence
  Description of Artificial Sequence: Synthetic oligonucleotide
gcgcgctcgctcgctcactgaggccgtcgggcgacctttggtcgcccggcctcagtgagcgagcgagcgcgc

SEQ ID NO: 104 - DNA, 72 bp, Artificial Sequence
  Description of Artificial Sequence: Synthetic oligonucleotide
gcgcgctcgctcgctcactgaggccgggcgaccaaaggtcgcccgacggcctcagtgagcgagcgagcgcgc

SEQ ID NO: 105 - DNA, 72 bp, Artificial Sequence
  Description of Artificial Sequence: Synthetic oligonucleotide
gcgcgctcgctcgctcactgaggccgcccgggcaaagcccgggcgtcggcctcagtgagcgagcgagcgcgc

SEQ ID NO: 106 - DNA, 72 bp, Artificial Sequence
  Description of Artificial Sequence: Synthetic oligonucleotide
gcgcgctcgctcgctcactgaggccgacgcccgggctttgcccgggcggcctcagtgagcgagcgagcgcgc

SEQ ID NO: 107 - DNA, 83 bp, Artificial Sequence
  Description of Artificial Sequence: Synthetic oligonucleotide
gcgcgctcgctcgctcactgaggccgcccgggcaaagcccgggcgtcgggctttgcccggcctcagtgagcgagcgagcgcgc

SEQ ID NO: 108 - DNA, 83 bp, Artificial Sequence
  Description of Artificial Sequence: Synthetic oligonucleotide
gcgcgctcgctcgctcactgaggccgggcaaagcccgacgcccgggctttgcccgggcggcctcagtgagcgagcgagcgcgc

SEQ ID NO: 109 - DNA, 77 bp, Artificial Sequence
  Description of Artificial Sequence: Synthetic oligonucleotide
gcgcgctcgctcgctcactgaggccgaaacgtcgggcgacctttggtcgcccggcctcagtgagcgagcgagcgcgc

SEQ ID NO: 110 - DNA, 77 bp, Artificial Sequence
  Description of Artificial Sequence: Synthetic oligonucleotide
gcgcgctcgctcgctcactgaggccgggcgaccaaaggtcgcccgacgtttcggcctcagtgagcgagcgagcgcgc

SEQ ID NO: 111 - DNA, 51 bp, Artificial Sequence
  Description of Artificial Sequence: Synthetic oligonucleotide
gcgcgctcgctcgctcactgaggcaaagcctcagtgagcgagcgagcgcgc

SEQ ID NO: 112 - DNA, 51 bp, Artificial Sequence
  Description of Artificial Sequence: Synthetic oligonucleotide
gcgcgctcgctcgctcactgaggctttgcctcagtgagcgagcgagcgcgc

SEQ ID NO: 113 - DNA, 80 bp, Artificial Sequence
  Description of Artificial Sequence: Synthetic oligonucleotide
gcgcgctcgctcgctcactgaggccgcccgggcgtcgggcgacctttggtcgcccggcctcagtgagcgagcgagcgcgc

SEQ ID NO: 114 - DNA, 80 bp, Artificial Sequence
  Description of Artificial Sequence: Synthetic oligonucleotide
gcgcgctcgctcgctcactgaggccgggcgaccaaaggtcgcccgacgcccgggcggcctcagtgagcgagcgagcgcgc

SEQ ID NO: 115 - DNA, 79 bp, Artificial Sequence
  Description of Artificial Sequence: Synthetic oligonucleotide
gcgcgctcgctcgctcactgaggcgcccgggcgtcgggcgacctttggtcgcccggcctcagtgagcgagcgagcgcgc

SEQ ID NO: 116 - DNA, 79 bp, Artificial Sequence
  Description of Artificial Sequence: Synthetic oligonucleotide
gcgcgctcgctcgctcactgaggccgggcgaccaaaggtcgcccgacgcccgggcgcctcagtgagcgagcgagcgcgc

SEQ ID NO: 117 - protein, 5 aa, Influenza virus
DRLRR

SEQ ID NO: 118 - protein, 7 aa, Influenza virus
PKQKKRK

SEQ ID NO: 119 - protein, 10 aa, Hepatitis delta virus
RKLKKKIKKL

SEQ ID NO: 120 - protein, 10 aa, Mus musculus
REKKKFLKRR

SEQ ID NO: 121 - protein, 20 aa, Homo sapiens
KRKGDEVDGVDEVAKKKSKK

SEQ ID NO: 122 - protein, 17 aa, Homo sapiens
RKCLQAGMNLEARKTKK

SEQ ID NO: 123 - DNA, 8 bp, Artificial Sequence
  Description of Artificial Sequence: Synthetic oligonucleotide
gtttaaac

SEQ ID NO: 124 - DNA, 8 bp, Artificial Sequence
  Description of Artificial Sequence: Synthetic oligonucleotide
ttaattaa

SEQ ID NO: 125 - DNA, 141 bp, Artificial Sequence; identical to SEQ ID NO: 78
  Description of Artificial Sequence: Synthetic polynucleotide

SEQ ID NO: 126 - DNA, 317 bp, Artificial Sequence; identical to SEQ ID NO: 79
  Description of Artificial Sequence: Synthetic polynucleotide

SEQ ID NO: 127 - DNA, 72 bp, Artificial Sequence; identical to SEQ ID NO: 104
  Description of Artificial Sequence: Synthetic oligonucleotide

SEQ ID NO: 128 - DNA, 60 bp, Artificial Sequence
  Description of Artificial Sequence: Synthetic oligonucleotide
gagacagacacactcctgctatgggtactgctgctctgggttccaggttccactggtgac

SEQ ID NO: 129 - DNA, 1260 bp, Adeno-associated virus - 2
atggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctga

SEQ ID NO: 130 - DNA, 1932 bp, Adeno-associated virus - 2
atgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctga

SEQ ID NO: 131 - DNA, 1876 bp, Artificial Sequence
  Description of Artificial Sequence: Synthetic polynucleotide
cgcagccaccatggcggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataa

SEQ ID NO: 132 - DNA, 1194 bp, Artificial Sequence
  Description of Artificial Sequence: Synthetic polynucleotide
atggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagaccgctaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataa

SEQ ID NO: 133 - DNA, 1876 bp, Artificial Sequence; identical to SEQ ID NO: 131
  Description of Artificial Sequence: Synthetic polynucleotide

SEQ ID NO: 134 - DNA, 51 bp, Artificial Sequence
  Description of Artificial Sequence: Synthetic oligonucleotide
ctaggccgcccgggcaaagcccgggcgtcgggcgacctttggtcgcccggc

SEQ ID NO: 135 - DNA, 65 bp, Artificial Sequence
  Description of Artificial Sequence: Synthetic oligonucleotide
ctaggactgaggccgcccgggcaaagcccgggcgtcgggcgacctttggtcgcccggcctcagtc

SEQ ID NO: 136 - DNA, 67 bp, Artificial Sequence
  Description of Artificial Sequence: Synthetic oligonucleotide
ggactgaggccgcccgggcaaagcccgggcgtcgggcgacctttggtcgcccggcctcagtcctgca

SEQ ID NO: 137 - DNA, 41 bp, Artificial Sequence
  Description of Artificial Sequence: Synthetic oligonucleotide
gtgcgggcgaccaaaggtcgcccgacgcccgggcgcactca

SEQ ID NO: 138 - DNA, 56 bp, Artificial Sequence
  Description of Artificial Sequence: Synthetic oligonucleotide
ggactgaggccgggcgaccaaaggtcgcccgacgcccgggcggcctcagtcctgca

SEQ ID NO: 139 - DNA, 54 bp, Artificial Sequence
  Description of Artificial Sequence: Synthetic oligonucleotide
ctaggactgaggccgcccgggcgtcgggcgacctttggtcgcccggcctcagtc

SEQ ID NO: 140 - DNA, 48 bp, Artificial Sequence
  Description of Artificial Sequence: Synthetic oligonucleotide
ggactgaggccgggcgaccaaaggtcgcccgacggcctcagtcctgca

SEQ ID NO: 141 - DNA, 46 bp, Artificial Sequence
  Description of Artificial Sequence: Synthetic oligonucleotide
ctaggactgaggccgtcgggcgacctttggtcgcccggcctcagtc

SEQ ID NO: 142 - DNA, 67 bp, Artificial Sequence
  Description of Artificial Sequence: Synthetic oligonucleotide
ggactgaggcccgggcgaccaaaggtcgcccgacgcccgggctttgcccgggcgcctcagtcctgca

SEQ ID NO: 143 - DNA, 47 bp, Artificial Sequence
  Description of Artificial Sequence: Synthetic oligonucleotide
atacctaggcacgcgtgttactagttattaatagtaatcaattacgg

SEQ ID NO: 144 - DNA, 29 bp, Artificial Sequence
  Description of Artificial Sequence: Synthetic oligonucleotide
atacctaggggccgcacgcgtgttactag

SEQ ID NO: 145 - DNA, 42 bp, Artificial Sequence
  Description of Artificial Sequence: Synthetic oligonucleotide
atacactcagtgcctgcaggcacgtggtccggagatccagac

SEQ ID NO: 146 - DNA, 3754 bp, Artificial Sequence
  Description of Artificial Sequence: Synthetic polynucleotide
cctaggtgagcgagcgagcgcgcagagagggagtggccaactccatcactaggggttccttgtagttaatgattaacccgccatgctacttatcgcggccgctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttttagccttcttctttttcctacagctcctgggcaacgtgctggttattgtgctgtctcatcatttgtcgacagaattcctcgaagatccgaaggggttcaagcttggcattccggtactgttggtaaagccagtttaaacgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcagcaggaacccctagtgatggagttggccactccctctctgcgcgctcgctcgctccctgcaggactgaggccgggcgaccaaaggtcgcccgacgcccgggcggcctcagtcctgcagg

SEQ ID NO: 147 - DNA, 8418 bp, Artificial Sequence
  Description of Artificial Sequence: Synthetic polynucleotide
ggcagctgcgcgctcgctcgctcacctaggccgcccgggcaaagcccgggcgtcgggcgacctttggtcgcccggcctaggtgagcgagcgagcgcgcagagagggagtggccaactccatcactaggggttccttgtagttaatgattaacccgccatgctacttatcgcggccgctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttttagccttcttctttttcctacagctcctgggcaacgtgctggttattgtgctgtctcatcatttgtcgacagaattcctcgaagatccgaaggggttcaagcttggcattccggtactgttggtaaagccagtttaaacgccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcagcaggaacccctagtgatggagttggccactccctctctgcgcgctcgctcgctccctgcaggactgaggccgggcgaccaaaggtcgcccgacgcccgggcggcctcagtcctgcagggagcgagcgagcgcgcagctgcctgcacgggcgcgccggtaccgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattgggaccaatacgcccgcgtttcttccttttccccaccccaacccccaagttcgggtgaaggcccagggctcgcagccaacgtcggggcggcaagccctgccatagccactacgggtacgtaggccaaccactagaactatagctagagtcctgggcgaacaaacgatgctcgccttccagaaaaccgaggatgcgaaccacttcatccggggtcagcaccaccggcaagcgccgcgacggccgaggtctaccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggccgcggagttgttcggtaaattgtcacaacgccgcgaatatagtctttaccatgcccttggccacgcccctctttaatacgacgggcaatttgcacttcagaaaatgaagagtttgctttagccataacaaaagtccagtatgctttttcacagcataactggactgatttcagtttacaactattctgtctagtttaagactttattgtcatagtttagatctattttgttcagtttaagactttattgtccgcccacacccgcttacgcagggcatccatttattactcaaccgtaaccgattttgccaggttacgcggctggtctgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcaaataagcgttgatattcagtcaattacaaacattaataacgaagagatgacagaaaaattttcattctgtgacagagaaaaagtagccgaagatgacggtttgtcacatggagttggcaggatgtttgattaaaaacataacaggaagaaaaatgccccgctgtgggcggacaaaatagttgggaactgggaggggtggaaatggagtttttaaggattatttagggaagagtgacaaaatagatgggaactgggtgtagcgtcgtaagctaatacgaaaattaaaaatgacaaaatagtttggaactagatttcacttatctggttcggatctcctagtgagctccctgca

SEQ ID NO: 148 - DNA, 225 bp, Artificial Sequence; identical to SEQ ID NO: 68
  Description of Artificial Sequence: Synthetic polynucleotide

SEQ ID NO: 149 - DNA, 1177 bp, Artificial Sequence; identical to SEQ ID NO: 74
  Description of Artificial Sequence: Synthetic polynucleotide

SEQ ID NO: 150 - DNA, 1326 bp, Artificial Sequence
  Description of Artificial Sequence: Synthetic polynucleotide
ctgcagggcccactagtggagccgagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaa

SEQ ID NO: 151 - DNA, 573 bp, Mus musculus
gtaagagttttatgttttttcatctctgcttgtatttttctagtaatggaagcctggtattttaaaatagttaaattttcctttagtgctgatttctagattattattactgttgttgttgttattattgtcattatttgcatctgagaacccttaggtggttatattattgatatatttttggtatctttgatgacaataatgggggattttgaaagcttagctttaaatttcttttaattaaaaaaaaatgctaggcagaatgactcaaattacgttggatacagttgaatttattacggtctcatagggcctgcctgctcgaccatgctatactaaaaattaaaagtgtgtgttactaattttataaatggagtttccatttatatttacctttatttcttatttaccattgtcttagtagatatttacaaacatgacagaaacactaaatcttgagtttgaatgcacagatataaacacttaacgggttttaaaaataataatgttggtgaaaaaatataactttgagtgtagcagagaggaaccattgccaccttcagattttcctgt

SEQ ID NO: 152 - DNA, 1993 bp, Mus musculus
acgatcgggaactggcatcttcagggagtagcttaggtcagtgaagagaagaacaaaaagcagcatattacagttagttgtcttcatcaatctttaaatatgttgtgtggtttttctctccctgtttccacagacaagagtgagatcgcccatcggtataatgatttgggagaacaacatttcaaaggcctgtaagttataatgctgaaagcccacttaatatttctggtagtattagttaaagttttaaaacacctttttccaccttgagtgtgagaattgtagagcagtgctgtccagtagaaatgtgtgcattgacagaaagactgtggatctgtgctgagcaatgtggcagccagagatcacaaggctatcaagcactttgcacatggcaagtgtaactgagaagcacacattcaaataatagttaattttaattgaatgtatctagccatgtgtggctagtagctcctttcctggagagagaatctggagcccacatctaacttgttaagtctggaatcttattttttatttctggaaaggtctatgaactatagttttgggggcagctcacttactaacttttaatgcaataagatctcatggtatcttgagaacattattttgtctctttgtagtactgaaaccttatacatgtgaagtaaggggtctatacttaagtcacatctccaaccttagtaatgttttaatgtagtaaaaaaatgagtaattaatttatttttagaaggtcaatagtatcatgtattccaaataacagaggtatatggttagaaaagaaacaattcaaaggacttatataatatctagccttgacaatgaataaatttagagagtagtttgcctgtttgcctcatgttcataaatctattgacacatatgtgcatctgcacttcagcatggtagaagtccatattcctttgcttggaaaggcaggtgttcccattacgcctcagagaatagctgacgggaagaggctttctagatagttgtatgaaagatatacaaaatctcgcaggtatacacaggcatgatttgctggttgggagagccacttgcctcatactgaggtttttgtgtctgcttttcagagtcctgattgccttttcccagtatctccagaaatgctcatacgatgagcatgccaaattagtgcaggaagtaacagactttgcaaagacgtgtgttgccgatgagtctgccgccaactgtgacaaatcccttgtgagtaccttctgattttgtggatctactttcctgctttctggaactctgtttcaaagccaatcatgactccatcacttaaggccccgggaacactgtggcagagggcagcagagagattgataaagccagggtgatgggaattttctgtgggactccatttcatagtaattgcagaagctacaatacactcaaaaagtctcaccacatgactgcccaaatgggagcttgacagtgacagtgacagtagatatgccaaagtggatgagggaaagaccacaagagctaaaccctgtaaaaagaactgtaggcaactaaggaatgcagagagaagaagttgccttggaagagcataccaactgcctctccaataccaatggtcatccctaaaacatacgtatgaataacatgcagactaagcaggctacatttaggaatatacatgtatttacataaatgtatatgcatgtaacaacaatgaatgaaaactgaggtcatggatctgaaagagagcaagggggcttacatgagagggtttggagggaggggttggagggagggaggtattattctttagttttacagggaacgtagtaaaaacataggcttctcccaaaggagcagagcccatgaggagctgtgcaaggttccccagcttgattttacctgctcctcaaattcccttgatttgtttttattataatgactttactcctagcttttagtgtcagatagaaaacatggaagg

SEQ ID NO: 153 - DNA, 1350 bp, Homo sapiens
taggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatggtccaggctgcagtgagccatgatcgtgccactgcactccagcctgggcgacagagtgagaccctgtctcacaacaacaacaacaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttatttt

SEQ ID NO: 154 - DNA, 1223 bp, Homo sapiens
tgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactg

SEQ ID NO: 155 - DNA, 215 bp, Artificial Sequence
  Description of Artificial Sequence: Synthetic polynucleotide
gaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccac

SEQ ID NO: 156 - DNA, 141 bp, Artificial Sequence
  Description of Artificial Sequence: Synthetic polynucleotide
cctgcaggcagctgcgcgctcgctcgctcacctaggccgcccgggcaaagcccgggcgtcgggcgacctttggtcgcccggcctaggtgagcgagcgagcgcgcagagagggagtggccaactccatcactaggggttcct

SEQ ID NO: 157 - DNA, 19 bp, Artificial Sequence
  Description of Artificial Sequence: Synthetic oligonucleotide
gcgcgctcgctcgctcacc

SEQ ID NO: 158 - DNA, 22 bp, Artificial Sequence
  Description of Artificial Sequence: Synthetic oligonucleotide
ctaggtgagcgagcgagcgcgc

SEQ ID NO: 159 - DNA, 75 bp, Artificial Sequence
  Description of Artificial Sequence: Synthetic oligonucleotide
cctgcaggactgaggccgcccgggcaaagcccgggcgtcgggcgacctttggtcgcccggcctcagtcctgcagg

SEQ ID NO: 160 - DNA, 130 bp, Artificial Sequence
  Description of Artificial Sequence: Synthetic polynucleotide
aggaacccctagtgatggagttggccactccctctctgcgcgctcgctcgctcactgagtgcgggcgaccaaaggtcgcccgacgcccgggcgcactcagtgagcgagcgagcgcgcagctgcctgcagg

SEQ ID NO: 161 - DNA, 142 bp, Artificial Sequence
  Description of Artificial Sequence: Synthetic polynucleotide
cctgcaggcagctgcgcgctcgctcgctccctaggactgaggccgcccgggcgtcgggcgacctttggtcgcccggcctcagtcctagggagcgagcgagcgcgcagagagggagtggccaactccatcactaggggttcct

SEQ ID NO: 162 - DNA, 80 bp, Artificial Sequence
  Description of Artificial Sequence: Synthetic oligonucleotide
gcgcgctcgctcgctcactgagtgcgggcgaccaaaggtcgcccgacgcccgggcgcactcagtgagcgagcgagcgcgc

SEQ ID NO: 163 - DNA, 21 bp, Artificial Sequence
  Description of Artificial Sequence: Synthetic oligonucleotide
gcgcgctcgctcgctcactga

SEQ ID NO: 164 - DNA, 18 bp, Artificial Sequence
  Description of Artificial Sequence: Synthetic oligonucleotide
gtgagcgagcgagcgcgc

SEQ ID NO: 165 - DNA, 89 bp, Artificial Sequence
  Description of Artificial Sequence: Synthetic oligonucleotide
gcgcgctcgctcgctcactgaggccgcccgggcaaagcccgggcgtcgggcgactttgtcgcccggcctcagtgagcgagcgagcgcgc

SEQ ID NO: 166 - DNA, 89 bp, Artificial Sequence
  Description of Artificial Sequence: Synthetic oligonucleotide
gcgcgctcgctcgctcactgaggccgggcgacaaagtcgcccgacgcccgggctttgcccgggcggcctcagtgagcgagcgagcgcgc

SEQ ID NO: 167 - DNA, 87 bp, Artificial Sequence
  Description of Artificial Sequence: Synthetic oligonucleotide
gcgcgctcgctcgctcactgaggccgcccgggcaaagcccgggcgtcgggcgattttcgcccggcctcagtgagcgagcgagcgcgc

SEQ ID NO: 168 - DNA, 87 bp, Artificial Sequence
  Description of Artificial Sequence: Synthetic oligonucleotide
gcgcgctcgctcgctcactgaggccgggcgaaaatcgcccgacgcccgggctttgcccgggcggcctcagtgagcgagcgagcgcgc

SEQ ID NO: 169 - DNA, 85 bp, Artificial Sequence
  Description of Artificial Sequence: Synthetic oligonucleotide
gcgcgctcgctcgctcactgaggccgcccgggcaaagcccgggcgtcgggcgtttcgcccggcctcagtgagcgagcgagcgcgc

SEQ ID NO: 170 - DNA, 85 bp, Artificial Sequence
  Description of Artificial Sequence: Synthetic oligonucleotide
gcgcgctcgctcgctcactgaggccgggcgaaacgcccgacgcccgggctttgcccgggcggcctcagtgagcgagcgagcgcgc

SEQ ID NO: 171 - DNA, 89 bp, Artificial Sequence
  Description of Artificial Sequence: Synthetic oligonucleotide
gcgcgctcgctcgctcactgaggccgcccgggaaacccgggcgtcgggcgacctttggtcgcccggcctcagtgagcgagcgagcgcgc

SEQ ID NO: 172 - DNA, 89 bp, Artificial Sequence
  Description of Artificial Sequence: Synthetic oligonucleotide
gcgcgctcgctcgctcactgaggccgggcgaccaaaggtcgcccgacgcccgggtttcccgggcggcctcagtgagcgagcgagcgcgc

SEQ ID NO: 173 - DNA, 87 bp, Artificial Sequence
  Description of Artificial Sequence: Synthetic oligonucleotide
gcgcgctcgctcgctcactgaggccgcccggaaaccgggcgtcgggcgacctttggtcgcccggcctcagtgagcgagcgagcgcgc

SEQ ID NO: 174 - DNA, 87 bp, Artificial Sequence
  Description of Artificial Sequence: Synthetic oligonucleotide
gcgcgctcgctcgctcactgaggccgggcgaccaaaggtcgcccgacgcccggtttccgggcggcctcagtgagcgagcgagcgcgc

SEQ ID NO: 175 - DNA, 85 bp, Artificial Sequence
  Description of Artificial Sequence: Synthetic oligonucleotide
gcgcgctcgctcgctcactgaggccgcccgaaacgggcgtcgggcgacctttggtcgcccggcctcagtgagcgagcgagcgcgc

SEQ ID NO: 176 - DNA, 85 bp, Artificial Sequence
  Description of Artificial Sequence: Synthetic oligonucleotide
gcgcgctcgctcgctcactgaggccgggcgaccaaaggtcgcccgacgcccgtttcgggcggcctcagtgagcgagcgagcgcgc

SEQ ID NO: 177 - DNA, 83 bp, Artificial Sequence
  Description of Artificial Sequence: Synthetic oligonucleotide
gcgcgctcgctcgctcactgaggccgcccaaagggcgtcgggcgacctttggtcgcccggcctcagtgagcgagcgagcgcgc

SEQ ID NO: 178 - DNA, 83 bp, Artificial Sequence
  Description of Artificial Sequence: Synthetic oligonucleotide
gcgcgctcgctcgctcactgaggccgggcgaccaaaggtcgcccgacgccctttgggcggcctcagtgagcgagcgagcgcgc

SEQ ID NO: 179 - DNA, 81 bp, Artificial Sequence
  Description of Artificial Sequence: Synthetic oligonucleotide
gcgcgctcgctcgctcactgaggccgccaaaggcgtcgggcgacctttggtcgcccggcctcagtgagcgagcgagcgcgc

SEQ ID NO: 180 - DNA, 81 bp, Artificial Sequence
  Description of Artificial Sequence: Synthetic oligonucleotide
gcgcgctcgctcgctcactgaggccgggcgaccaaaggtcgcccgacgcctttggcggcctcagtgagcgagcgagcgcgc

SEQ ID NO: 181 - DNA, 79 bp, Artificial Sequence
  Description of Artificial Sequence: Synthetic oligonucleotide
gcgcgctcgctcgctcactgaggccgcaaagcgtcgggcgacctttggtcgcccggcctcagtgagcgagcgagcgcgc

SEQ ID NO: 182 - DNA, 79 bp, Artificial Sequence
  Description of Artificial Sequence: Synthetic oligonucleotide
gcgcgctcgctcgctcactgaggccgggcgaccaaaggtcgcccgacgctttgcggcctcagtgagcgagcgagcgcgc

SEQ ID NO: 183 - DNA, 81 bp, Artificial Sequence
  Description of Artificial Sequence: Synthetic oligonucleotide
ctgcgcgctcgctcgctcactgaggccgaaacgtcgggcgacctttggtcgcccggcctcagtgagcgagcgagcgcgcag

SEQ ID NO: 184 - DNA, 81 bp, Artificial Sequence
  Description of Artificial Sequence: Synthetic oligonucleotide
ctgcgcgctcgctcgctcactgaggccgggcgaccaaaggtcgcccgacgtttcggcctcagtgagcgagcgagcgcgcag

SEQ ID NO: 185 - DNA, 72 bp, Artificial Sequence; identical to SEQ ID NO: 104
  Description of Artificial Sequence: Synthetic oligonucleotide

SEQ ID NO: 186 - DNA, 80 bp, Artificial Sequence; identical to SEQ ID NO: 114
  Description of Artificial Sequence: Synthetic oligonucleotide

SEQ ID NO: 187 - DNA, 79 bp, Artificial Sequence; identical to SEQ ID NO: 115
  Description of Artificial Sequence: Synthetic oligonucleotide

SEQ ID NO: 188 - DNA, 48 bp, Artificial Sequence
  Description of Artificial Sequence: Synthetic oligonucleotide
ggagtcaaagttctgtttgccctgatctgcatcgctgtggccgaggcc

SEQ ID NO: 189 - DNA, 99 bp, Artificial Sequence
  Description of Artificial Sequence: Synthetic oligonucleotide
attcataccaacttgaagaaaaagttcagcctcttcatcctggtctttctcctgttcgcagtcatctgtgtttggaagaaagggagcgactatgaggcc

SEQ ID NO: 190 - DNA, 588 bp, Artificial Sequence
  Description of Artificial Sequence: Synthetic polynucleotide
gcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaacc

SEQ ID NO: 191 - DNA, 399 bp, Artificial Sequence
  Description of Artificial Sequence: Synthetic polynucleotide
cgggggaggctgctggtgaatattaaccaaggtcaccccagttatcggaggagcaaacaggggctaagtccacacgcgtggtaccgtctgtctgcacatttcgtagagcgagtgttccgatactctaatctccctaggcaaggttcatatttgtgtaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgaagaggtaagggtttaagggatggttggttggtggggtattaatgtttaattacctggagcacctgcctgaaatcactttttttcaggttg

SEQ ID NO: 192 - DNA, 14359 bp, Artificial Sequence
  Description of Artificial Sequence: Synthetic polynucleotide
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatccggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgcaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaggtaccggatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcccagaagcttcagccagaatagcagacacccctccaccagacagaagcagttcaacgccacaacaatccccgagaacgacatcgagaaaaccgatccttggtttgcccacagaacccctatgcctaagatccagaacgtgtcctccagcgatctgctgatgctcctgagacagagccctacacctcacggactgagcctgtccgatctgcaagaggccaaatacgaaaccttcagcgacgacccttctcctggcgccatcgacagcaacaatagcctgagcgagatgacccacttcagaccacagctgcaccacagcggcgacatggtgtttacacctgagagcggcctccagctgagactgaatgagaagctgggaaccaccgccgccaccgagctgaagaaactggacttcaaggtgtcctctaccagcaacaacctgatcagcacaatcccctccgacaacctggctgccggcaccgacaacacatcttctctgggcccacctagcatgcccgtgcactacgatagccagctggataccacactgttcggcaagaagtctagccctctgacagagtctggcggccctctgtctctgagcgaggaaaacaacgacagcaagctgctggaatccggcctgatgaacagccaagagtcctcctggggcaagaatgtgtccagcaccgagtccggcagactgttcaagggaaagagagcccacggacctgctctgctgaccaaggataacgccctgttcaaagtgtccatcagcctgctcaagaccaacaagacctccaacaactccgccaccaacagaaagacccacatcgacggccctagcctgctgatcgagaatagccctagcgtctggcagaatatcctggaaagcgacaccgagttcaagaaagtgacccctctgatccacgaccggatgctcatggacaagaacgccaccgctctgcggctgaaccacatgagcaacaagacaaccagcagcaagaatatggaaatggtgcagcagaagaaagagggccccattcctccagacgctcagaaccccgatatgagcttcttcaagatgctctttctgcccgagagcgcccggtggattcagagaacacacggcaagaactccctgaactccggccagggaccttctccaaagcagctggtttccctgggacctgagaagtccgtggaaggacagaacttcctgagcgaaaagaacaaagtggtcgtcggcaagggcgagttcaccaaggatgtgggcctgaaagagatggtctttcccagcagccggaacctgttcctgaccaacctggacaacctgcacgagaacaacacccacaatcaagagaagaagatccaagaggaaatcgaaaagaaagagacactcatccaagagaacgtggtgctgcctcagatccacacagtgaccggcaccaagaactttatgaagaatctgttcctgctgagtacccggcagaacgtggaaggcagctacgatggcgcttatgcccctgtgctgcaggacttcagatccctgaacgactccaccaatcggacaaagaagcacacagcccacttctccaagaagggcgaagaagagaacctggaaggactgggcaatcagaccaagcagatcgtcgagaagtacgcctgcaccaccagaatcagccccaacacaagccagcagaacttcgtgacccagcggagcaaaagagccctgaagcagtttcggctgcccctggaagaaaccgagctggaaaagcggatcatcgtggacgacaccagcacacagtggtccaagaacatgaagcacttgacccctagcacactgacccagatcgactacaacgagaaagagaagggcgctatcacacagagcccactgagcgactgtctgaccagaagccacagcatccctcaggccaacagatcccctctgccaatcgccaaagtgtctagcttccccagcatcagacccatctacctgaccagagtgctgttccaggacaacagcagccatctgccagccgccagctaccggaagaaagattctggcgtgcaagagagcagccactttctgcagggcgctaagaagaacaatctgagcctggctattctgaccctggaaatgaccggcgatcagagagaagtcggctctctgggcaccagcgccacaaatagcgtgacctacaaaaaggtggaaaacaccgtgctgcctaagcctgacctgccaaagacaagcggcaaggtggaactgctgccaaaggtgcacatctaccagaaggacctgtttcctaccgagacaagcaacggctctcccggccatctggatctggtggaaggatctctgctgcagggaaccgagggcgccatcaagtggaacgaggccaatagacctggcaaggtgcccttcctgagagtggccacagagtccagcgccaagacaccctctaaactgctggaccctctggcctgggacaaccactatggcactcagatccccaaagaggaatggaagtcccaagagaagtcccctgaaaagaccgccttcaagaagaaggacaccattctgtccctgaatgcctgcgagagcaaccacgccattgccgccatcaatgagggccagaacaagcccgagatcgaagtgacctgggccaagcagggaagaaccgagagactgtgtagccagaatcctcctgtgctgaagcggcaccagagagaaatcacccggaccacactgcagagcgaccaagaagagatcgattacgacgataccatcagcgtcgagatgaagaaagaagatttcgacatctacgacgaggacgagaatcagagccctcggagcttccagaagaaaaccaggcactactttattgccgccgtcgagcggctgtgggactacggaatgtctagctctcctcacgtgctgcggaatagagcccagtctggtagcgtgccccagttcaaaaaggtcgtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatctcctacgaagaggaccagagacagggcgcagagccccggaagaatttcgtgaagcccaacgagactaagacctacttttggaaggtgcagcaccatatggcccctacaaaggacgagttcgactgcaaagcctgggcctacttctccgatgtggacctcgaaaaggacgtgcacagcggactcatcggcccactgcttgtgtgccacaccaacacactgaaccccgctcacggcagacaagtgacagtgcaagagttcgccctgtttttcaccatcttcgacgaaacgaagtcctggtacttcaccgaaaacatggaaagaaactgcagggccccttgcaacattcagatggaagatcccaccttcaaagagaactaccggttccacgccatcaacggctacatcatggacacactgcccggcctggttatggcccaggatcagagaatccggtggtatctgctgtccatgggctccaacgagaatatccactccatccacttcagcggccacgtgttcaccgtgcggaaaaaagaagagtacaaaatggccctgtacaatctgtaccctggggtgttcgaaaccgttgagatgctgcctagcaaggccggaatttggagagtggaatgtctgattggagagcacctccacgccgggatgagcaccctgtttctggtgtactccaacaagtgtcagacccctctcggcatggcctctggccacattagagacttccagatcaccgccagcggacagtatggacagtgggcccctaaactggccagactgcactactccggcagcatcaatgcctggtccaccaaagagcctttcagctggatcaaagtggacctgctggctcccatgatcatccacggaatcaagacccagggcgccagacaaaagttcagcagcctgtacatcagccagttcatcatcatgtacagcctggacggaaagaagtggcagacctaccggggcaatagcaccggcacactgatggtgttcttcggcaacgtggactccagcggcattaagcacaacatcttcaaccctccaatcattgcccggtacatccggctgcaccccacacactacagcatcaggtctaccctgagaatggaactgatgggctgcgacctgaacagctgctctatgcccctcggaatggaaagcaaggccatcagcgacgcccagatcacagcctctagctacttcaccaacatgttcgccacttggagcccctctaaggcccggcttcatctgcaaggcagaagcaacgcttggaggccccaagtgaacaaccccaaagaatggctccaggtggactttcagaaaaccatgaaagtgacaggcgtgaccacacagggcgtcaagtccctgctgacctctatgtacgtgaaagagtttctgatcagctccagccaggacggccaccagtggaccctgttcttccagaacggcaaagtgaaagtgttccagggaaatcaggacagcttcacacccgtggtcaatagtctggacccaccactgctgacccgctacctgcgaattcaccctcagtcttgggtgcaccagattgccctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgg

SEQ ID NO: 193 - DNA, 11677 bp, Artificial Sequence
  Description of Artificial Sequence: Synthetic polynucleotide
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatccggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgcaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaggtaccggatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgg

SEQ ID NO: 194 - DNA, 13634 bp, Artificial Sequence
  Description of Artificial Sequence: Synthetic polynucleotide
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatccggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgcccctaaaatgggcaaacattgcaagcagcaaacagcaaacacacagccctccctgcctgctgaccttggagctggggcagaggtcagagacctctctgggcccatgccacctccaacatccactcgaccccttggaatttttcggtggagaggagcagaggttgtcctggcgtggtttaggtagtgtgagaggggaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcccagaagcttcagccagaatagcagacacccctccaccagacagaagcagttcaacgccacaacaatccccgagaacgacatcgagaaaaccgatccttggtttgcccacagaacccctatgcctaagatccagaacgtgtcctccagcgatctgctgatgctcctgagacagagccctacacctcacggactgagcctgtccgatctgcaagaggccaaatacgaaaccttcagcgacgacccttctcctggcgccatcgacagcaacaatagcctgagcgagatgacccacttcagaccacagctgcaccacagcggcgacatggtgtttacacctgagagcggcctccagctgagactgaatgagaagctgggaaccaccgccgccaccgagctgaagaaactggacttcaaggtgtcctctaccagcaacaacctgatcagcacaatcccctccgacaacctggctgccggcaccgacaacacatcttctctgggcccacctagcatgcccgtgcactacgatagccagctggataccacactgttcggcaagaagtctagccctctgacagagtctggcggccctctgtctctgagcgaggaaaacaacgacagcaagctgctggaatccggcctgatgaacagccaagagtcctcctggggcaagaatgtgtccagcaccgagtccggcagactgttcaagggaaagagagcccacggacctgctctgctgaccaaggataacgccctgttcaaagtgtccatcagcctgctcaagaccaacaagacctccaacaactccgccaccaacagaaagacccacatcgacggccctagcctgctgatcgagaatagccctagcgtctggcagaatatcctggaaagcgacaccgagttcaagaaagtgacccctctgatccacgaccggatgctcatggacaagaacgccaccgctctgcggctgaaccacatgagcaacaagacaaccagcagcaagaatatggaaatggtgcagcagaagaaagagggccccattcctccagacgctcagaaccccgatatgagcttcttcaagatgctctttctgcccgagagcgcccggtggattcagagaacacacggcaagaactccctgaactccggccagggaccttctccaaagcagctggtttccctgggacctgagaagtccgtggaaggacagaacttcctgagcgaaaagaacaaagtggtcgtcggcaagggcgagttcaccaaggatgtgggcctgaaagagatggtctttcccagcagccggaacctgttcctgaccaacctggacaacctgcacgagaacaacacccacaatcaagagaagaagatccaagaggaaatcgaaaagaaagagacactcatccaagagaacgtggtgctgcctcagatccacacagtgaccggcaccaagaactttatgaagaatctgttcctgctgagtacccggcagaacgtggaaggcagctacgatggcgcttatgcccctgtgctgcaggacttcagatccctgaacgactccaccaatcggacaaagaagcacacagcccacttctccaagaagggcgaagaagagaacctggaaggactgggcaatcagaccaagcagatcgtcgagaagtacgcctgcaccaccagaatcagccccaacacaagccagcagaacttcgtgacccagcggagcaaaagagccctgaagcagtttcggctgcccctggaagaaaccgagctggaaaagcggatcatcgtggacgacaccagcacacagtggtccaagaacatgaagcacttgacccctagcacactgacccagatcgactacaacgagaaagagaagggcgctatcacacagagcccactgagcgactgtctgaccagaagccacagcatccctcaggccaacagatcccctctgccaatcgccaaagtgtctagcttccccagcatcagacccatctacctgaccagagtgctgttccaggacaacagcagccatctgccagccgccagctaccggaagaaagattctggcgtgcaagagagcagccactttctgcagggcgctaagaagaacaatctgagcctggctattctgaccctggaaatgaccggcgatcagagagaagtcggctctctgggcaccagcgccacaaatagcgtgacctacaaaaaggtggaaaacaccgtgctgcctaagcctgacctgccaaagacaagcggcaaggtggaactgctgccaaaggtgcacatctaccagaaggacctgtttcctaccgagacaagcaacggctctcccggccatctggatctggtggaaggatctctgctgcagggaaccgagggcgccatcaagtggaacgaggccaatagacctggcaaggtgcccttcctgagagtggccacagagtccagcgccaagacaccctctaaactgctggaccctctggcctgggacaaccactatggcactcagatccccaaagaggaatggaagtcccaagagaagtcccctgaaaagaccgccttcaagaagaaggacaccattctgtccctgaatgcctgcgagagcaaccacgccattgccgccatcaatgagggccagaacaagcccgagatcgaagtgacctgggccaagcagggaagaaccgagagactgtgtagccagaatcctcctgtgctgaagcggcaccagagagaaatcacccggaccacactgcagagcgaccaagaagagatcgattacgacgataccatcagcgtcgagatgaagaaagaagatttcgacatctacgacgaggacgagaatcagagccctcggagcttccagaagaaaaccaggcactactttattgccgccgtcgagcggctgtgggactacggaatgtctagctctcctcacgtgctgcggaatagagcccagtctggtagcgtgccccagttcaaaaaggtcgtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatctcctacgaagaggaccagagacagggcgcagagccccggaagaatttcgtgaagcccaacgagactaagacctacttttggaaggtgcagcaccatatggcccctacaaaggacgagttcgactgcaaagcctgggcctacttctccgatgtggacctcgaaaaggacgtgcacagcggactcatcggcccactgcttgtgtgccacaccaacacactgaaccccgctcacggcagacaagtgacagtgcaagagttcgccctgtttttcaccatcttcgacgaaacgaagtcctggtacttcaccgaaaacatggaaagaaactgcagggccccttgcaacattcagatggaagatcccaccttcaaagagaactaccggttccacgccatcaacggctacatcatggacacactgcccggcctggttatggcccaggatcagagaatccggtggtatctgctgtccatgggctccaacgagaatatccactccatccacttcagcggccacgtgttcaccgtgcggaaaaaagaagagtacaaaatggccctgtacaatctgtaccctggggtgttcgaaaccgttgagatgctgcctagcaaggccggaatttggagagtggaatgtctgattggagagcacctccacgccgggatgagcaccctgtttctggtgtactccaacaagtgtcagacccctctcggcatggcctctggccacattagagacttccagatcaccgccagcggacagtatggacagtgggcccctaaactggccagactgcactactccggcagcatcaatgcctggtccaccaaagagcctttcagctggatcaaagtggacctgctggctcccatgatcatccacggaatcaagacccagggcgccagacaaaagttcagcagcctgtacatcagccagttcatcatcatgtacagcctggacggaaagaagtggcagacctaccggggcaatagcaccggcacactgatggtgttcttcggcaacgtggactccagcggcattaagcacaacatcttcaaccctccaatcattgcccggtacatccggctgcaccccacacactacagcatcaggtctaccctgagaatggaactgatgggctgcgacctgaacagctgctctatgcccctcggaatggaaagcaaggccatcagcgacgcccagatcacagcctctagctacttcaccaacatgttcgccacttggagcccctctaaggcccggcttcatctgcaaggcagaagcaacgcttggaggccccaagtgaacaaccccaaagaatggctccaggtggactttcagaaaaccatgaaagtgacaggcgtgaccacacagggcgtcaagtccctgctgacctctatgtacgtgaaagagtttctgatcagctccagccaggacggccaccagtggaccctgttcttccagaacggcaaagtgaaagtgttccagggaaatcaggacagcttcacacccgtggtcaatagtctggacccaccactgctgacccgctacctgcgaattcaccctcagtcttgggtgcaccagattgccctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgg

SEQ ID NO: 195 - DNA, 10952 bp, Artificial Sequence
  Description of Artificial Sequence: Synthetic polynucleotide
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatccggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgcccctaaaatgggcaaacattgcaagcagcaaacagcaaacacacagccctccctgcctgctgaccttggagctggggcagaggtcagagacctctctgggcccatgccacctccaacatccactcgaccccttggaatttttcggtggagaggagcagaggttgtcctggcgtggtttaggtagtgtgagaggggaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgg

SEQ ID NO: 196 - DNA, 14266 bp, Artificial Sequence
  Description of Artificial Sequence: Synthetic polynucleotide
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatccggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggtctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcccagaagcttcagccagaatagcagacacccctccaccagacagaagcagttcaacgccacaacaatccccgagaacgacatcgagaaaaccgatccttggtttgcccacagaacccctatgcctaagatccagaacgtgtcctccagcgatctgctgatgctcctgagacagagccctacacctcacggactgagcctgtccgatctgcaagaggccaaatacgaaaccttcagcgacgacccttctcctggcgccatcgacagcaacaatagcctgagcgagatgacccacttcagaccacagctgcaccacagcggcgacatggtgtttacacctgagagcggcctccagctgagactgaatgagaagctgggaaccaccgccgccaccgagctgaagaaactggacttcaaggtgtcctctaccagcaacaacctgatcagcacaatcccctccgacaacctggctgccggcaccgacaacacatcttctctgggcccacctagcatgcccgtgcactacgatagccagctggataccacactgttcggcaagaagtctagccctctgacagagtctggcggccctctgtctctgagcgaggaaaacaacgacagcaagctgctggaatccggcctgatgaacagccaagagtcctcctggggcaagaatgtgtccagcaccgagtccggcagactgttcaagggaaagagagcccacggacctgctctgctgaccaaggataacgccctgttcaaagtgtccatcagcctgctcaagaccaacaagacctccaacaactccgccaccaacagaaagacccacatcgacggccctagcctgctgatcgagaatagccctagcgtctggcagaatatcctggaaagcgacaccgagttcaagaaagtgacccctctgatccacgaccggatgctcatggacaagaacgccaccgctctgcggctgaaccacatgagcaacaagacaaccagcagcaagaatatggaaatggtgcagcagaagaaagagggccccattcctccagacgctcagaaccccgatatgagcttcttcaagatgctctttctgcccgagagcgcccggtggattcagagaacacacggcaagaactccctgaactccggccagggaccttctccaaagcagctggtttccctgggacctgagaagtccgtggaaggacagaacttcctgagcgaaaagaacaaagtggtcgtcggcaagggcgagttcaccaaggatgtgggcctgaaagagatggtctttcccagcagccggaacctgttcctgaccaacctggacaacctgcacgagaacaacacccacaatcaagagaagaagatccaagaggaaatcgaaaagaaagagacactcatccaagagaacgtggtgctgcctcagatccacacagtgaccggcaccaagaactttatgaagaatctgttcctgctgagtacccggcagaacgtggaaggcagctacgatggcgcttatgcccctgtgctgcaggacttcagatccctgaacgactccaccaatcggacaaagaagcacacagcccacttctccaagaagggcgaagaagagaacctggaaggactgggcaatcagaccaagcagatcgtcgagaagtacgcctgcaccaccagaatcagccccaacacaagccagcagaacttcgtgacccagcggagcaaaagagccctgaagcagtttcggctgcccctggaagaaaccgagctggaaaagcggatcatcgtggacgacaccagcacacagtggtccaagaacatgaagcacttgacccctagcacactgacccagatcgactacaacgagaaagagaagggcgctatcacacagagcccactgagcgactgtctgaccagaagccacagcatccctcaggccaacagatcccctctgccaatcgccaaagtgtctagcttccccagcatcagacccatctacctgaccagagtgctgttccaggacaacagcagccatctgccagccgccagctaccggaagaaagattctggcgtgcaagagagcagccactttctgcagggcgctaagaagaacaatctgagcctggctattctgaccctggaaatgaccggcgatcagagagaagtcggctctctgggcaccagcgccacaaatagcgtgacctacaaaaaggtggaaaacaccgtgctgcctaagcctgacctgccaaagacaagcggcaaggtggaactgctgccaaaggtgcacatctaccagaaggacctgtttcctaccgagacaagcaacggctctcccggccatctggatctggtggaaggatctctgctgcagggaaccgagggcgccatcaagtggaacgaggccaatagacctggcaaggtgcccttcctgagagtggccacagagtccagcgccaagacaccctctaaactgctggaccctctggcctgggacaaccactatggcactcagatccccaaagaggaatggaagtcccaagagaagtcccctgaaaagaccgccttcaagaagaaggacaccattctgtccctgaatgcctgcgagagcaaccacgccattgccgccatcaatgagggccagaacaagcccgagatcgaagtgacctgggccaagcagggaagaaccgagagactgtgtagccagaatcctcctgtgctgaagcggcaccagagagaaatcacccggaccacactgcagagcgaccaagaagagatcgattacgacgataccatcagcgtcgagatgaagaaagaagatttcgacatctacgacgaggacgagaatcagagccctcggagcttccagaagaaaaccaggcactactttattgccgccgtcgagcggctgtgggactacggaatgtctagctctcctcacgtgctgcggaatagagcccagtctggtagcgtgccccagttcaaaaaggtcgtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatctcctacgaagaggaccagagacagggcgcagagccccggaagaatttcgtgaagcccaacgagactaagacctacttttggaaggtgcagcaccatatggcccctacaaaggacgagttcgactgcaaagcctgggcctacttctccgatgtggacctcgaaaaggacgtgcacagcggactcatcggcccactgcttgtgtgccacaccaacacactgaaccccgctcacggcagacaagtgacagtgcaagagttcgccctgtttttcaccatcttcgacgaaacgaagtcctggtacttcaccgaaaacatggaaagaaactgcagggccccttgcaacattcagatggaagatcccaccttcaaagagaactaccggttccacgccatcaacggctacatcatggacacactgcccggcctggttatggcccaggatcagagaatccggtggtatctgctgtccatgggctccaacgagaatatccactccatccacttcagcggccacgtgttcaccgtgcggaaaaaagaagagtacaaaatggccctgtacaatctgtaccctggggtgttcgaaaccgttgagatgctgcctagcaaggccggaatttggagagtggaatgtctgattggagagcacctccacgccgggatgagcaccctgtttctggtgtactccaacaagtgtcagacccctctcggcatggcctctggccacattagagacttccagatcaccgccagcggacagtatggacagtgggcccctaaactggccagactgcactactccggcagcatcaatgcctggtccaccaaagagcctttcagctggatcaaagtggacctgctggctcccatgatcatccacggaatcaagacccagggcgccagacaaaagttcagcagcctgtacatcagccagttcatcatcatgtacagcctggacggaaagaagtggcagacctaccggggcaatagcaccggcacactgatggtgttcttcggcaacgtggactccagcggcattaagcacaacatcttcaaccctccaatcattgcccggtacatccggctgcaccccacacactacagcatcaggtctaccctgagaatggaactgatgggctgcgacctgaacagctgctctatgcccctcggaatggaaagcaaggccatcagcgacgcccagatcacagcctctagctacttcaccaacatgttcgccacttggagcccctctaaggcccggcttcatctgcaaggcagaagcaacgcttggaggccccaagtgaacaaccccaaagaatggctccaggtggactttcagaaaaccatgaaagtgacaggcgtgaccacacagggcgtcaagtccctgctgacctctatgtacgtgaaagagtttctgatcagctccagccaggacggccaccagtggaccctgttcttccagaacggcaaagtgaaagtgttccagggaaatcaggacagcttcacacccgtggtcaatagtctggacccaccactgctgacccgctacctgcgaattcaccctcagtcttgggtgcaccagattgccctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgg

SEQ ID NO: 197 - DNA, 11584 bp, Artificial Sequence
  Description of Artificial Sequence: Synthetic polynucleotide
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatccggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggtctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgg

SEQ ID NO: 198 - DNA, 11558 bp, Artificial Sequence
  Description of Artificial Sequence: Synthetic polynucleotide
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatccggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgcccctaaaatgggcaaacattgcaagcagcaaacagcaaacacacagccctccctgcctgctgaccttggagctggggcagaggtcagagacctctctgggcccatgccacctccaacatccactcgaccccttggaatttttcggtggagaggagcagaggttgtcctggcgtggtttaggtagtgtgagaggggaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcccagaagcttcagccagaatagcagacacccctccaccagacagaagcagttcaacgccacaacaatccccgagaacgacatcgagaaaaccgatccttggtttgcccacagaacccctatgcctaagatccagaacgtgtcctccagcgatctgctgatgctcctgagacagagccctacacctcacggactgagcctgtccgatctgcaagaggccaaatacgaaaccttcagcgacgacccttctcctggcgccatcgacagcaacaatagcctgagcgagatgacccacttcagaccacagctgcaccacagcggcgacatggtgtttacacctgagagcggcctccagctgagactgaatgagaagctgggaaccaccgccgccaccgagctgaagaaactggacttcaaggtgtcctctaccagcaacaacctgatcagcacaatcccctccgacaacctggctgccggcaccgacaacacatcttctctgggcccacctagcatgcccgtgcactacgatagccagctggataccacactgttcggcaagaagtctagccctctgacagagtctggcggccctctgtctctgagcgaggaaaacaacgacagcaagctgcctcctgtgctgaagcggcaccagcgggaaatcaccagaaccacactgcagagcgaccaagaggaaatcgattacgacgacaccatcagcgtcgagatgaagaaagaagatttcgacatctacgacgaggacgagaatcagagccccagatcctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatctcctacgaagaggaccagagacagggcgctgagccccggaagaatttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagggccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtactccaacaagtgtcagacccctctcggcatggcctctggacacatcagagacttccagatcaccgcctctggccagtacggacagtgggctcctaaactggctcggctgcactactccggcagcatcaatgcctggtccaccaaagagcccttcagctggatcaaggtggacctgctggctcccatgatcatccacggaatcaagacccagggcgcaagacagaagttcagcagcctgtacatcagccagttcatcatcatgtacagcctggacggaaagaagtggcagacctaccggggcaatagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgattagcagcagccaggacggccaccagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgg

SEQ ID NO: 199 - DNA, 12190 bp, Artificial Sequence
  Description of Artificial Sequence: Synthetic polynucleotide
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatccggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggtctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcccagaagcttcagccagaatagcagacacccctccaccagacagaagcagttcaacgccacaacaatccccgagaacgacatcgagaaaaccgatccttggtttgcccacagaacccctatgcctaagatccagaacgtgtcctccagcgatctgctgatgctcctgagacagagccctacacctcacggactgagcctgtccgatctgcaagaggccaaatacgaaaccttcagcgacgacccttctcctggcgccatcgacagcaacaatagcctgagcgagatgacccacttcagaccacagctgcaccacagcggcgacatggtgtttacacctgagagcggcctccagctgagactgaatgagaagctgggaaccaccgccgccaccgagctgaagaaactggacttcaaggtgtcctctaccagcaacaacctgatcagcacaatcccctccgacaacctggctgccggcaccgacaacacatcttctctgggcccacctagcatgcccgtgcactacgatagccagctggataccacactgttcggcaagaagtctagccctctgacagagtctggcggccctctgtctctgagcgaggaaaacaacgacagcaagctgcctcctgtgctgaagcggcaccagcgggaaatcaccagaaccacactgcagagcgaccaagaggaaatcgattacgacgacaccatcagcgtcgagatgaagaaagaagatttcgacatctacgacgaggacgagaatcagagccccagatcctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatctcctacgaagaggaccagagacagggcgctgagccccggaagaatttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagggccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtactccaacaagtgtcagacccctctcggcatggcctctggacacatcagagacttccagatcaccgcctctggccagtacggacagtgggctcctaaactggctcggctgcactactccggcagcatcaatgcctggtccaccaaagagcccttcagctggatcaaggtggacctgctggctcccatgatcatccacggaatcaagacccagggcgcaagacagaagttcagcagcctgtacatcagccagttcatcatcatgtacagcctggacggaaagaagtggcagacctaccggggcaatagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgattagcagcagccaggacggccaccagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgg

SEQ ID NO: 200 - DNA, 12165 bp, Artificial Sequence
  Description of Artificial Sequence: Synthetic polynucleotide
aaagtagccgaagatgacggtttgtcacatggagttggcaggatgtttgattaaaaacataacaggaagaaaaatgccccgctgtgggcggacaaaatagttgggaactgggaggggtggaaatggagtttttaaggattatttagggaagagtgacaaaatagatgggaactgggtgtagcgtcgtaagctaatacgaaaattaaaaatgacaaaatagtttggaactagatttcacttatctggttcggatctcctaggcctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatcgcggccgctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgcctttcgggggggacggggcagggcggggttcggcttctggcgtgtgaccggcggctctagagcctctgctaaccatgttttagcctttcttctttttcctacagctcctgggcaacgtgctggttattgtgctgtctcatcatttgtcgacagaattcctcgaagatccgaaggggttcaagcttggcattccggtactgttggtaaagccagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgattccataaagtaggaaacactacacgattccataaagtaggaaacactacatcactccataaagtaggaaacactacagttaactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcggcgcgccgcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggtcgacgctagcagctgatgcatagcatgcggtaccgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattgggaccaatacgcccgcgtttcttccttttccccaccccaacccccaagttcgggtgaaggcccagggctcgcagccaacgtcggggcggcaagccctgccatagccactacgggtacgtaggccaaccactagaactatagctagagtcctgggcgaacaaacgatgctcgccttccagaaaaccgaggatgcgaaccacttcatccggggtcagcaccaccggcaagcgccgcgacggccgaggtctaccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggccgcggagttgttcggtaaattgtcacaacgccgcgaatatagtctttaccatgcccttggccacgcccctctttaatacgacgggcaatttgcacttcagaaaatgaagagtttgctttagccataacaaaagtccagtatgctttttcacagcataactggactgatttcagtttacaactattctgtctagtttaagactttattgtcatagtttagatctattttgttcagtttaagactttattgtccgcccacacccgcttacgcagggcatccatttattactcaaccgtaaccgattttgccaggttacgcggctggtctgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcaaataagcgttgatattcagtcaattacaaacattaataacgaagagatgacagaaaaattttcattctgtgacagagaa

SEQ ID NO: 201 - DNA, 11512 bp, Artificial Sequence
  Description of Artificial Sequence: Synthetic polynucleotide
aaagtagccgaagatgacggtttgtcacatggagttggcaggatgtttgattaaaaacataacaggaagaaaaatgccccgctgtgggcggacaaaatagttgggaactgggaggggtggaaatggagtttttaaggattatttagggaagagtgacaaaatagatgggaactgggtgtagcgtcgtaagctaatacgaaaattaaaaatgacaaaatagtttggaactagatttcacttatctggttcggatctcctaggcctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatcgcggccgcaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaggtaccggatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtcatcgattccataaagtaggaaacactacacgattccataaagtaggaaacactacatcactccataaagtaggaaacactacagttaactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcggcgcgccgcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggtcgacgctagcagctgatgcatagcatgcggtaccgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattgggaccaatacgcccgcgtttcttccttttccccaccccaacccccaagttcgggtgaaggcccagggctcgcagccaacgtcggggcggcaagccctgccatagccactacgggtacgtaggccaaccactagaactatagctagagtcctgggcgaacaaacgatgctcgccttccagaaaaccgaggatgcgaaccacttcatccggggtcagcaccaccggcaagcgccgcgacggccgaggtctaccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggccgcggagttgttcggtaaattgtcacaacgccgcgaatatagtctttaccatgcccttggccacgcccctctttaatacgacgggcaatttgcacttcagaaaatgaagagtttgctttagccataacaaaagtccagtatgctttttcacagcataactggactgatttcagtttacaactattctgtctagtttaagactttattgtcatagtttagatctattttgttcagtttaagactttattgtccgcccacacccgcttacgcagggcatccatttattactcaaccgtaaccgattttgccaggttacgcggctggtctgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcaaataagcgttgatattcagtcaattacaaacattaataacgaagagatgacagaaaaattttcattctgtgacagagaa

SEQ ID NO: 202 - DNA, 10563 bp, Artificial Sequence
  Description of Artificial Sequence: Synthetic polynucleotide
aaagtagccgaagatgacggtttgtcacatggagttggcaggatgtttgattaaaaacataacaggaagaaaaatgccccgctgtgggcggacaaaatagttgggaactgggaggggtggaaatggagtttttaaggattatttagggaagagtgacaaaatagatgggaactgggtgtagcgtcgtaagctaatacgaaaattaaaaatgacaaaatagtttggaactagatttcacttatctggttcggatctcctaggcctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatcgcggccgccgggggaggctgctggtgaatattaaccaaggtcaccccagttatcggaggagcaaacaggggctaagtccacacgcgtggtaccgtctgtctgcacatttcgtagagcgagtgttccgatactctaatctccctaggcaaggttcatatttgtgtaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgaagaggtaagggtttaagggatggttggttggtggggtattaatgtttaattacctggagcacctgcctgaaatcactttttttcaggttggtttaaaccgcagccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgagccatggtgctagcagctgatgcatagcatgcggtaccgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattgggaccaatacgcccgcgtttcttccttttccccaccccaacccccaagttcgggtgaaggcccagggctcgcagccaacgtcggggcggcaagccctgccatagccactacgggtacgtaggccaaccactagaactatagctagagtcctgggcgaacaaacgatgctcgccttccagaaaaccgaggatgcgaaccacttcatccggggtcagcaccaccggcaagcgccgcgacggccgaggtctaccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggccgcggagttgttcggtaaattgtcacaacgccgcgaatatagtctttaccatgcccttggccacgcccctctttaatacgacgggcaatttgcacttcagaaaatgaagagtttgctttagccataacaaaagtccagtatgctttttcacagcataactggactgatttcagtttacaactattctgtctagtttaagactttattgtcatagtttagatctattttgttcagtttaagactttattgtccgcccacacccgcttacgcagggcatccatttattactcaaccgtaaccgattttgccaggttacgcggctggtctgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcaaataagcgttgatattcagtcaattacaaacattaataacgaagagatgacagaaaaattttcattctgtgacagagaa

SEQ ID NO: 203 - DNA, 9871 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagtttgctgcttgcaatgtttgcccattttagggtggacacaggacgctgtggtttctgagccagggggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgccaccatgcagattgagctgagcacctgcttcttcctgtgcctgctgaggttctgcttctctgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaaccccccagtgctgaagaggcaccagagggagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcacctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactgaaataaaagatctttattttcattagatctgtgtgttggttttttgtgtgtctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 204 - DNA, 9969 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagtctgtctgcacatttcgtagagcgagtgttccgatactctaatctccctaggcaaggttcatattgacttaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgctagcaggtaagtgccgtgtgtggttcccgcgggcctggcctctttacgggttatggcccttgcgtgccttgaattactgacactgacatccactttttctttttctccacaggtttaaacgccaccatgcagattgagctgagcacctgcttcttcctgtgtctgctgaggttctgcttctctgccaccaggaggtattacctgggggctgtggagctgagctgggactatatgcagtctgacctgggggagctgcctgtggatgctaggttcccccccagggtgcccaagagcttcccctttaacacttctgtggtgtacaagaagaccctgtttgtggagttcactgaccacctgttcaacattgccaagcccaggcccccctggatggggctgctggggcccaccatccaggctgaggtgtatgacactgtggtgatcaccctgaagaacatggccagccaccctgtgagcctgcatgctgtgggggtgagctactggaaggcttctgagggggctgagtatgatgaccagactagccagagggagaaggaggatgacaaggtgtttcctgggggcagccatacctatgtgtggcaggtgctgaaggagaatggccccatggcctctgaccccctgtgcctgacctacagctacctgtctcatgtggacctggtgaaggacctgaactctggcctgattggggctctgctggtgtgtagggagggcagcctggctaaggaaaagacccagaccctgcataagtttatcctgctgtttgctgtgtttgatgagggcaagagctggcactctgagaccaagaacagcctgatgcaggatagggatgctgcctctgccagggcttggcctaagatgcacactgtgaatgggtatgtgaataggagcctgcctggcctgattggctgccacaggaagtctgtgtactggcatgtgattgggatgggcaccacccctgaggtccatagcatcttcctggagggccacactttcctggtgaggaaccacagacaggcctctctggagatctctcccatcaccttcctgactgctcagactctgctgatggacctgggccagttcctgctgttttgccatattagcagccaccagcatgatgggatggaggcctatgtgaaggtggatagctgccctgaggagcctcagctgaggatgaagaacaatgaggaggctgaagactatgatgatgacctgactgattctgagatggatgtggtgaggtttgatgatgacaatagccccagcttcattcagatcaggtctgtggccaagaaacaccccaagacctgggtgcactacattgctgctgaggaagaggactgggactatgctcccctggtgctggcccctgatgataggtcttataagagccagtacctgaacaatgggccccagaggattggcaggaagtacaagaaggtgaggttcatggcctacactgatgaaaccttcaaaaccagggaggccattcagcatgagtctggcatcctgggccctctgctgtatggggaggtgggggacaccctgctgatcatcttcaagaaccaggccagcaggccctacaacatctatcctcatggcatcactgatgtgaggcccctgtacagcaggaggctgcccaagggggtgaagcacctgaaagacttccccatcctgcctggggagatctttaagtataagtggactgtgactgtggaggatggccctaccaagtctgaccccaggtgtctgaccaggtactattctagctttgtgaacatggagagggacctggcctctggcctgattgggcccctgctgatctgctacaaggagtctgtggaccagaggggcaaccagatcatgtctgacaagaggaatgtgatcctgttttctgtgtttgatgagaataggagctggtacctgactgagaacatccagaggtttctgcccaatcctgctggggtgcagctggaggatcctgagttccaggccagcaatatcatgcatagcatcaatggctatgtgtttgacagcctgcagctgtctgtgtgcctgcatgaggtggcctactggtacatcctgagcattggggcccagactgactttctgtctgtgttcttttctggctataccttcaagcacaagatggtgtatgaggataccctgaccctgttccccttctctggggagactgtgttcatgagcatggagaatcctgggctgtggatcctggggtgccacaactctgattttaggaacagggggatgactgccctgctgaaggtgtctagctgtgataagaacactggggactactatgaggacagctatgaggacatttctgcttatctgctgtctaagaataatgccattgagcccagaagcttcagccagaatccccctgtgctgaagagacatcagagggagatcaccagaactaccctgcagtctgatcaggaggagattgactatgatgacactatctctgtggagatgaagaaggaggactttgacatctatgatgaggatgagaatcagtctcccaggagctttcagaagaagaccagacattacttcattgctgctgtggagaggctgtgggactatggcatgagctctagccctcatgtgctgaggaacagggcccagtctggctctgtgccccagttcaagaaggtggtgttccaggaattcactgatggcagcttcacccagcccctgtacaggggggagctgaatgagcacctgggcctgctggggccttatatcagggctgaggtggaggataatattatggtgactttcaggaaccaggccagcaggccctactctttctatagcagcctgatctcttatgaggaggatcagaggcagggggctgagcctaggaagaactttgtgaagcccaatgagactaagacctacttctggaaggtccagcaccacatggcccctaccaaggatgagtttgactgcaaggcctgggcctatttctctgatgtggatctggagaaggatgtccattctgggctgattggccccctgctggtgtgccacactaacactctgaatcctgcccatggcaggcaggtgactgtccaggagtttgccctgttcttcactatctttgatgagaccaagagctggtactttactgagaacatggagaggaactgcagagctccttgcaatattcagatggaggaccccaccttcaaggagaattacaggttccatgccattaatgggtacatcatggacaccctgcctggcctggtgatggctcaggaccagaggatcaggtggtacctgctgagcatgggctctaatgagaatatccacagcatccacttctctgggcatgtgttcactgtgaggaagaaggaggagtacaagatggctctgtataatctgtaccctggggtgtttgaaactgtggagatgctgccctctaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactattctggcagcatcaatgcctggagcaccaaggagcccttcagctggatcaaggtggacctgctggcccccatgatcattcatggcatcaagacccagggggccaggcagaagttcagctctctgtacatctctcagttcatcatcatgtactctctggatgggaagaagtggcagacctacaggggcaacagcactggcaccctgatggtgttctttgggaatgtggactcttctggcatcaagcacaacatcttcaatccccccatcattgctaggtatattaggctgcatcccacccactacagcatcaggtctaccctgaggatggagctgatgggctgtgacctgaactcttgcagcatgcccctgggcatggagtctaaggccatctctgatgcccagattactgccagcagctacttcaccaacatgtttgccacctggagcccctctaaggccaggctgcatctgcaggggaggagcaatgcctggaggcctcaggtgaacaaccccaaggagtggctgcaggtggatttccagaagaccatgaaggtgactggggtgaccacccagggggtcaagagcctgctgaccagcatgtatgtgaaggagttcctgatcagcagcagccaggatggccaccagtggactctgttctttcagaatgggaaggtgaaggtgtttcagggcaatcaggactctttcacccctgtggtgaacagcctggacccccccctgctgaccagatacctgaggatccacccccagtcttgggtgcatcagattgccctgaggatggaggtgctgggctgtgaggctcaggatctgtactgagcggccgcaataaaagatcagagctctagagatctgtgtgttggttttttgtgttctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 205 - DNA, 10063 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagaggaaccattgccaccttcagggggaggctgctggtgaatattaaccaagatcaccccagttaccggaggagcaaacagggactaagttcacacgcgtggtaccgtctgtctgcacatttcgtagagcgagtgttccgatactctaatctccctaggcaaggttcatatttgtgtaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgaagaggtaagggtttaagttatcgttagttcgtgcaccattaatgtttaattacctggagcacctgcctgaaatcatttttttttcaggttggctagtatgcagatcgagctctccacctgcttctttctgtgcctgttgagattctgcttcagcgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaatccacccgtccttaagcgccatcagcgcgagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcatctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactgaggatccaataaaatatctttattttcattacatctgtgtgttggttttttgtgtgttttcctgtaacgatcgggtctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 206 - DNA, 11668 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagaaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaggtaccggatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaacgccgccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 207 - DNA, 11719 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagaaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaggtaccggatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaacgccgccaccatgcagattgagctgagcacctgcttcttcctgtgcctgctgaggttctgcttctctgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaatgccactaatgtgtctaacaacagcaacaccagcaatgacagcaatgtgtctcccccagtgctgaagaggcaccagagggagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcacctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactgattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 208 - DNA, 11796 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagaaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaggtaccggatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatccggactctaaggtaaatataaaatttttaagtgtataatgtgttaaactactgattctaattgtttctctcttttagattccaacctttggaactgagtttaaacgccgccaccatgcagattgagctgagcacctgcttcttcctgtgcctgctgaggttctgcttctctgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaatgccactaatgtgtctaacaacagcaacaccagcaatgacagcaatgtgtctcccccagtgctgaagaggcaccagagggagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcacctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactgattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctccataaagtaggaaacactacacgattccataaagtaggaaacactacatcactccataaagtaggaaacactacatgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 209 - DNA, 10795 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagacgggggaggctgctggtgaatattaaccaaggtcaccccagttatcggaggagcaaacaggggctaagtccacacgcgtggtaccgtctgtctgcacatttcgtagagcgagtgttccgatactctaatctccctaggcaaggttcatatttgtgtaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgaagaggtaagggtttaagggatggttggttggtggggtattaatgtttaattacctggagcacctgcctgaaatcactttttttcaggttggtttaaacgccgccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 210 - DNA, 10846 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagacgggggaggctgctggtgaatattaaccaaggtcaccccagttatcggaggagcaaacaggggctaagtccacacgcgtggtaccgtctgtctgcacatttcgtagagcgagtgttccgatactctaatctccctaggcaaggttcatatttgtgtaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgaagaggtaagggtttaagggatggttggttggtggggtattaatgtttaattacctggagcacctgcctgaaatcactttttttcaggttggtttaaacgccgccaccatgcagattgagctgagcacctgcttcttcctgtgcctgctgaggttctgcttctctgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaatgccactaatgtgtctaacaacagcaacaccagcaatgacagcaatgtgtctcccccagtgctgaagaggcaccagagggagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcacctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactgattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 211 - DNA, 10923 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagacgggggaggctgctggtgaatattaaccaaggtcaccccagttatcggaggagcaaacaggggctaagtccacacgcgtggtaccgtctgtctgcacatttcgtagagcgagtgttccgatactctaatctccctaggcaaggttcatatttgtgtaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgaagaggtaagggtttaagggatggttggttggtggggtattaatgtttaattacctggagcacctgcctgaaatcactttttttcaggttggtttaaacgccgccaccatgcagattgagctgagcacctgcttcttcctgtgcctgctgaggttctgcttctctgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaatgccactaatgtgtctaacaacagcaacaccagcaatgacagcaatgtgtctcccccagtgctgaagaggcaccagagggagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcacctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactgattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctccataaagtaggaaacactacacgattccataaagtaggaaacactacatcactccataaagtaggaaacactacatgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 212 - DNA, 12404 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagcggccgctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttttagccttcttctttttcctacagctcctgggcaacgtgctggttattgtgctgtctcatcatttgtcgacagaattcctcgaagatccgaaggggttcaagcttggcattccggtactgttggtaaagccagtttaaacgccgccaccatgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactagttaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctccataaagtaggaaacactacacgattccataaagtaggaaacactacatcactccataaagtaggaaacactacatgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 213 - DNA, 11356 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagagagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtggagaagagcatgcttgagggctgagtgcccctcagtgggcagagagcacatggcccacagtccctgagaagttggggggaggggtgggcaattgaactggtgcctagagaaggtggggcttgggtaaactgggaaagtgatgtggtgtactggctccacctttttccccagggtgggggagaaccatatataagtgcagtagtctctgtgaacattcaagcttctgccttctccctcctgtgagtttggtaagtcactgactgtctatgcctgggaaagggtgggcaggagatggggcagtgcaggaaaagtggcactatgaaccctgcagccctagacaattgtactaaccttcttctctttcctctcctgacaggttggtgtacagtagcttccgtttaaacgccgccaccatgcagattgagctgagcacctgcttcttcctgtgcctgctgaggttctgcttctctgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaatgccactaatgtgtctaacaacagcaacaccagcaatgacagcaatgtgtctcccccagtgctgaagaggcaccagagggagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcacctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactgattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctccataaagtaggaaacactacacgattccataaagtaggaaacactacatcactccataaagtaggaaacactacatgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagatctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 214 - DNA, 11434 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagacgggggaggctgctggtgaatattaaccaaggtcaccccagttatcggaggagcaaacaggggctaagtccacacgcgtggtaccgtctgtctgcacatttcgtagagcgagtgttccgatactctaatctccctaggcaaggttcatatttgtgtaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgaagaggtaagggtttaagggatggttggttggtggggtattaatgtttaattacctggagcacctgcctgaaatcactttttttcaggttggtttaaacgccgccaccatgcaaattgagttaagtacctgttttttcctgtgcctgttgagattttgcttctctgctaccagaaggtattacctgggagctgtggagctgtcatgggactacatgcagtctgacctgggagagctccctgttgatgctaggtttccccctagggtgccaaagtcctttccttttaacacctcagtggtgtacaagaagacactgtttgtggagtttactgaccacctcttcaatattgctaagccaagacccccttggatgggtctcttgggccctaccatccaggctgaggtttatgatacagtggtgattaccctcaagaatatggcttctcatcctgttagtctgcatgcagtaggggtcagctattggaaggccagtgaaggagctgagtatgatgaccagaccagccagagagagaaagaggatgacaaggtgttccctgggggatcacacacctatgtgtggcaggtgttgaaggaaaatggacccatggcctctgacccactctgcctgacttactcctacctgtctcatgtggacctggtcaaagatctgaactctggcctgattggggcactgttggtgtgcagagaagggtctcttgccaaggagaagactcagaccctgcacaagttcatcctgctgtttgctgtgtttgatgaaggcaagtcttggcattctgagactaagaacagcctgatgcaagatagagatgctgcatctgccagggcctggcctaagatgcacactgtgaatggatatgtgaataggtccttgcctggcctgattggatgccataggaagtctgtgtactggcatgtgattggcatgggcaccacccctgaggttcactctatttttctggagggccatactttccttgtgaggaatcatagacaggcctctctggagattagccctattacatttctgactgctcagaccctcctcatggacttggggcagtttctgttaagctgccacatcagcagccatcaacatgatggtatggaagcctatgtcaaagtggatagctgccctgaagaaccacagcttaggatgaagaacaatgaggaggcagaggactatgatgatgatctgactgattctgaaatggatgtggtgagatttgatgatgataatagcccttcctttatccagatcaggtcagtggccaagaagcacccaaagacctgggtgcattatattgctgctgaggaggaggactgggactatgcccctctggtgctggcccctgatgatagaagctataagtctcaatacttgaataatggcccacagaggattgggagaaagtacaaaaaggtgagatttatggcctacactgatgagactttcaagaccagagaggccatccagcatgaatcaggcattttgggtcccctgctgtatggagaggtgggggataccctgctgatcatctttaagaaccaggccagcagaccttacaacatttaccctcatgggatcacagatgtgaggccactctactctaggagattgcccaagggagtcaagcatcttaaggactttccaatcctgcctggggagatcttcaagtacaaatggacagtgacagttgaggatggacctactaagagtgaccccaggtgtctgaccagatattactctagctttgtcaatatggaaagagacctggcttcaggcttgataggccctcttctcatctgctacaaagagtctgtggaccagagaggaaatcagattatgtctgacaagagaaatgttattctgttttcagtctttgatgagaacagaagttggtacttgacagagaacattcagagatttctgcctaaccctgcaggagtgcagcttgaggaccctgagtttcaggcttccaatatcatgcattctatcaatggctatgtgtttgatagcctgcagctgtctgtgtgcctgcatgaggttgcctattggtacatcctgtctattggggcccaaactgatttcttgtctgtgtttttcagtggatatacctttaagcataagatggtgtatgaagataccttgacacttttccctttctcaggagagactgtcttcatgtctatggagaaccctggactgtggatcctgggatgccacaactcagacttcagaaacaggggtatgacagctctgcttaaggtctcctcatgtgacaaaaatacaggagactactatgaagattcctatgaggacatctctgcttacctgctcagcaaaaacaatgccattgagcccagaagcttcagccagaattccagacatcccagtactaggcagaagcagtttaatgccaccaccatcccagaaaatgacattgagaagacagacccttggtttgcccatagaaccccaatgcccaagattcagaatgtgagcagctcagacttgctgatgctgctgaggcagtctcctactccccatggcctgtccctctcagatctgcaggaagccaagtatgagacattttctgatgacccctccccaggggctattgacagtaacaacagcctgtctgaaatgacccacttcagacctcagctccaccacagtggggatatggtgtttaccccagagtcaggcctgcagctgagactgaatgagaagctgggaaccacagctgccacagaactgaagaagctggatttcaaggtgagctctacttcaaataatctgatttccactatcccatctgacaatttggcagctggcactgacaatacaagctctctgggcccacctagcatgccagtgcattatgacagccagttggacaccactctttttggaaagaaatccagtcccctgacagagtcaggaggacccctttctctgtctgaggagaacaatgatagtaagcttctggagtcaggcttgatgaactcccaggagagttcttggggcaagaatgtgagctctagggagatcaccagaaccactctgcagtctgaccaagaagagattgattatgatgacactatctctgttgagatgaagaaggaggactttgatatctatgatgaggatgagaaccagtctccaagaagtttccagaagaagaccaggcactactttattgctgctgtggagagactgtgggactatggaatgtcctcctcccctcatgtcctgagaaatagagctcagtcaggatcagtgccccagttcaagaaggtggtgttccaggaattcacagatggaagttttacccagccactgtatagaggtgaactgaatgaacatctgggtctgctggggccctatatcagggctgaggtggaggacaatattatggtgacctttagaaaccaggcctcaaggccctacagcttctactcttccctcatttcatatgaggaagaccagagacagggagcagagcctagaaagaactttgtcaagcccaatgaaaccaaaacctatttctggaaggtgcagcaccacatggcacccaccaaagatgagtttgactgcaaagcctgggcctatttctcagatgtggatctggagaaggatgtccattcaggtctgattggaccactcctggtgtgccacaccaacacactgaatccagctcatggcagacaggtgacagtccaggagtttgccctgtttttcactatttttgatgagaccaagagctggtattttacagagaatatggaaagaaactgcagagccccttgtaatatccagatggaggacccaacctttaaggagaactacaggttccatgccatcaatggctacattatggataccctgcctggcctggttatggcccaggatcagaggatcaggtggtatctgctgtcaatgggctccaatgagaacattcatagtattcacttttcaggacatgtgttcacagtgagaaagaaggaggagtataagatggccctctataatctctacccaggggtgtttgagacagttgagatgctgccatctaaggcaggcatctggagagtggaatgcctcattggagagcacctgcatgctggcatgtccaccctgtttctggtgtactccaacaaatgtcagacccctcttggtatggcctctggccacattagggatttccagattactgccagtggtcagtatgggcagtgggcccctaagctggccagactgcactattctgggagcatcaatgcctggtccaccaaggaacctttttcttggattaaagtggatctgctggccccaatgatcatccatgggatcaagacccagggagctaggcagaagttcagcagcctgtacattagtcagttcatcattatgtacagtctggatggcaaaaagtggcagacatacaggggcaattccactggaaccctgatggtgttctttggaaatgtggatagcagtggtatcaagcacaacattttcaaccctcccatcattgccaggtacatcagactgcatccaacccactacagcattaggagcacccttaggatggagctcatggggtgtgacctgaactcttgctctatgccacttggaatggagagcaaggccatctctgatgcccagattactgctagttcctacttcaccaatatgtttgccacctggtcacccagcaaggccaggctgcacctgcagggaaggtccaatgcttggaggcctcaggtgaacaatccaaaggagtggctgcaggtggacttccagaagactatgaaggtgacaggagtgaccactcagggagtgaagagcctgctgacctccatgtatgtgaaggagtttctgatctccagctcccaggatggccaccagtggaccctgttctttcagaatggcaaggtgaaggtgtttcaggggaatcaggactccttcaccccagtggtgaattccctggatccccctctgctgaccagatacctgagaatccacccccagtcttgggtgcaccagattgcccttaggatggaggtgctgggctgtgaggcccaggacctgtactgattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 215 - DNA, 13477 bp, Artificial Sequence
  Description of Artificial Sequence: Synthetic polynucleotide
ggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagacgggggaggctgctggtgaatattaaccaaggtcaccccagttatcggaggagcaaacaggggctaagtccacacgcgtggtaccgtctgtctgcacatttcgtagagcgagtgttccgatactctaatctccctaggcaaggttcatatttgtgtaggttacttattctccttttgttgactaagtcaataatcagaatcagcaggtttggagtcagcttggcagggatcagcagcctgggttggaaggagggggtataaaagccccttcaccaggagaagccgtcacacagatccacaagctcctgaagaggtaagggtttaagggatggttggttggtggggtattaatgtttaattacctggagcacctgcctgaaatcactttttttcaggttggtttaaacgccgccaccatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgattaattaagagcatcttaccgccatttattcccatatttgttctgtttttcttgatttgggtatacatttaaatgttaataaaacaaaatggtggggcaatcatttacatttttagggatatgtaattactagttcaggtgtattgccacaagacaaacatgttaagaaactttcccgttatttacgctctgttcctgttaatcaacctctggattacaaaatttgtgaaagattgactgatattcttaactatgttgctccttttacgctgtgtggatatgctgctttatagcctctgtatctagctattgcttcccgtacggctttcgttttctcctccttgtataaatcctggttgctgtctcttttagaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctctagagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgcctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgatatcgcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcgccatgggatcc

SEQ ID NO: 216 - DNA, 11180 bp, Artificial Sequence
  Description of Artificial Sequence: Synthetic polynucleotide
aaagtagccgaagatgacggtttgtcacatggagttggcaggatgtttgattaaaaacataacaggaagaaaaatgccccgctgtgggcggacaaaatagttgggaactgggaggggtggaaatggagtttttaaggattatttagggaagagtgacaaaatagatgggaactgggtgtagcgtcgtaagctaatacgaaaattaaaaatgacaaaatagtttggaactagatttcacttatctggttcggatctcctaggctcaagcagtgatcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcctctagtacttctcgacaagcttgtcgagactgcaggctctagaggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcatatggagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtggagaagagcatgcttgagggctgagtgcccctcagtgggcagagagcacatggcccacagtccctgagaagttggggggaggggtgggcaattgaactggtgcctagagaaggtggggcttgggtaaactgggaaagtgatgtggtgtactggctccacctttttccccagggtgggggagaaccatatataagtgcagtagtctctgtgaacattcaagcttctgccttctccctcctgtgagtttggtaagtcactgactgtctatgcctgggaaagggtgggcaggagatggggcagtgcaggaaaagtggcactatgaaccctgcagccctagacaattgtactaaccttcttctctttcctctcctgacaggttggtgtacagtagcttccgtttaaacagccaccatgcagatagaattatctacttgtttttttctttgtctgctcaggttctgcttctctgctacaaggaggtattacttaggtgctgtagagttatcttgggactacatgcagtctgatcttggggagctccctgtggatgcaagatttccccctagagtacctaaaagtttccctttcaacacaagtgtggtgtataagaagactctgtttgttgagttcacagatcaccttttcaatattgccaagcccagacccccctggatgggtctactggggccaacaattcaagcagaggtatatgatacagtggtgatcacattaaagaacatggcatcccaccctgtaagcctgcatgctgttggtgtgtcctattggaaagcaagtgaaggtgctgaatatgatgatcaaacatcccaaagagagaaggaagatgacaaagtcttcccaggtggctctcacacctatgtgtggcaagtgctcaaggaaaatgggcctatggctagtgatccattgtgcctcacatatagctacctgtcccatgtggacttagttaaagatctgaactcaggtctgattggtgccctgctggtctgtagggaaggatcactagctaaagaaaaaacccagactttacacaagttcatcttattatttgctgtttttgatgagggaaagagctggcactcagagactaagaattcactcatgcaggatagagatgcagcttctgctagagcatggccaaaaatgcatactgtgaatgggtatgttaacaggagtctgcctggcctcataggctgccatagaaaatcagtgtactggcatgtcataggtatgggcactactcctgaggtgcattccatttttttggaggggcatactttccttgtaagaaaccacaggcaggcttcattggaaattagtccaataacctttctcacagcccagactctgctaatggacttggggcagtttttattattttgtcacattagctctcatcagcatgatggaatggaagcctatgttaaggttgattcctgcccagaagagccccagttgagaatgaagaacaatgaggaagcagaagactatgatgatgatctaacagactcagaaatggatgttgtgagatttgatgatgataactccccaagttttattcagatcaggtcagtggccaagaaacatccaaaaacatgggttcattatattgcagcagaagaagaagactgggattatgcacccttggtattagcccctgatgacagaagctataagtcacaatatctcaacaatggaccccagagaattggcagaaagtacaaaaaagtcaggtttatggcttatactgatgagactttcaaaactagagaggctattcaacatgaatctggcatcctaggtcctttgttatatggggaagtaggggacaccttattaattatatttaaaaaccaggccagtaggccttacaacatttacccccacggtataacagatgtcagaccactgtactcaaggaggctaccaaaaggggtgaagcacctaaaagacttccccatcctacctggtgagattttcaagtataagtggacagtgactgtagaagatggtccaaccaaatcagatcccagatgcctgacaaggtactacagtagctttgtaaatatggagagagacctggcctcagggttaatagggcccctactgatctgctacaaggagagtgtagaccaaagaggcaaccaaattatgtcagacaagagaaatgtcatcctctttagtgtttttgatgagaataggtcctggtacctgacagaaaatatccaaagattccttccaaatccagcaggggtacaactggaggaccctgagttccaggcctccaatatcatgcacagcatcaatggttatgtgtttgacagtttgcaactttcagtgtgccttcatgaggttgcatactggtatatactttctataggggcccagacagacttcttgtcagttttcttttcaggctatactttcaagcataagatggtatatgaagataccctgactctttttccctttagtggtgagacagttttcatgtcaatggaaaacccagggctttggatcttgggatgccacaactctgactttagaaacagaggcatgactgcccttttaaaggtgtcctcttgtgataagaatactggagactactatgaggacagctatgaggacatttcagcctatctgctgtcaaaaaataatgctatagagccaaggtcattttctcaaaatcctcctgtcctgaagaggcaccaaagagagataaccaggactaccttacagtctgaccaggaggaaattgattatgatgacacaataagtgtggagatgaaaaaggaggattttgatatttatgatgaggatgaaaaccaatctccaagatctttccagaagaagactagacactatttcattgctgcagtggaaagactgtgggactatggaatgtcctccagccctcatgttctcaggaatagggctcaaagtggttctgtgccacagttcaagaaggtggtgtttcaggaattcacagatgggtcctttactcaaccactgtataggggagaactcaatgaacatctaggattactaggtccctacattagagctgaggtggaggacaatatcatggtcactttcaggaaccaggcatctagaccatactctttttacagctccttgatatcttatgaagaggaccagagacagggtgcagaacccaggaagaactttgtgaaacccaatgagaccaaaacatacttctggaaggtccagcatcatatggctcctaccaaggatgaatttgactgcaaagcctgggcttacttctcagatgtggatttggagaaagatgtgcacagtggcttgattgggcctcttttggtatgtcataccaacaccttaaaccctgctcatggaagacaagtaacagtgcaagagtttgccctctttttcactatatttgatgagacaaaaagttggtactttactgagaatatggagaggaactgcagggctccctgcaatatacagatggaggatcctactttcaaggaaaactataggtttcatgccattaatggctatatcatggatacattgcctggcttagttatggcccaggatcagagaatcagatggtacctccttagtatgggaagcaatgaaaacatacattctattcacttcagtggacatgtctttactgtgagaaaaaaggaagagtacaagatggcactgtacaatctgtaccctggagtgtttgagacagttgagatgctgcccagcaaggctgggatctggagggtagaatgcctgattggagaacacttacatgcaggtatgtccactctattcttggtctattccaacaagtgtcagacccccctaggcatggcatctggccatattagagatttccagataactgcttctggtcagtatggccagtgggcccccaagcttgctagacttcactacagtggttcaataaatgcctggtccaccaaggagcccttcagctggattaaagtggacttgctagcccccatgatcattcatgggataaaaacacagggtgccagacagaaattttcatctctgtacatcagccagtttatcatcatgtacagtctggatggcaaaaaatggcagacctacagaggtaactctacaggtacactaatggtattttttggcaatgtagattcatcaggtatcaagcataatatctttaatcctcccattattgccagatacatcaggttgcacccaactcattacagtataagatccactttaaggatggagcttatggggtgtgaccttaatagctgcagtatgcccttgggaatggaaagtaaggccatatcagatgcccagattactgcaagcagctactttacaaacatgtttgcaacctggtctcctagtaaagccaggctgcacttgcagggtaggagcaatgcatggagaccccaggtcaataacccaaaagagtggcttcaagttgactttcaaaagacaatgaaggtaacaggggtaaccacccaaggggtaaagagtctgctgacatctatgtatgtaaaagaattcctcatctcaagtagtcaagatgggcaccagtggacactgttcttccagaatggaaaagttaaggtgttccaaggtaatcaagacagcttcactccagtggtgaacagtctggatccaccactcctaaccaggtacctgaggatccaccctcagtcctgggtccaccagatagctctgagaatggaagtgctgggctgtgaagctcaggacctatactgattaattaataaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagctccataaagtaggaaacactacacgattccataaagtaggaaacactacatcactccataaagtaggaaacactacacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtacttaagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgccgctagcagctgatgcatagcatgcggtaccgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattgggaccaatacgcccgcgtttcttccttttccccaccccaacccccaagttcgggtgaaggcccagggctcgcagccaacgtcggggcggcaagccctgccatagccactacgggtacgtaggccaaccactagaactatagctagagtcctgggcgaacaaacgatgctcgccttccagaaaaccgaggatgcgaaccacttcatccggggtcagcaccaccggcaagcgccgcgacggccgaggtctaccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggccgcggagttgttcggtaaattgtcacaacgccgcgaatatagtctttaccatgcccttggccacgcccctctttaatacgacgggcaatttgcacttcagaaaatgaagagtttgctttagccataacaaaagtccagtatgctttttcacagcataactggactgatttcagtttacaactattctgtctagtttaagactttattgtcatagtttagatctattttgttcagtttaagactttattgtccgcccacacccgcttacgcagggcatccatttattactcaaccgtaaccgattttgccaggttacgcggctggtctgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcaaataagcgttgatattcagtcaattacaaacattaataacgaagagatgacagaaaaattttcattctgtgacagagaa

SEQ ID NO: 217 - DNA, 13862 bp, Artificial Sequence
  Description of Artificial Sequence: Synthetic polynucleotide
aaagtagccgaagatgacggtttgtcacatggagttggcaggatgtttgattaaaaacataacaggaagaaaaatgccccgctgtgggcggacaaaatagttgggaactgggaggggtggaaatggagtttttaaggattatttagggaagagtgacaaaatagatgggaactgggtgtagcgtcgtaagctaatacgaaaattaaaaatgacaaaatagtttggaactagatttcacttatctggttcggatctcctaggctcaagcagtgatcagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcctctagtacttctcgacaagcttgtcgagactgcaggctctagaggccggcccctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgcatatggagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgactagtggagaagagcatgcttgagggctgagtgcccctcagtgggcagagagcacatggcccacagtccctgagaagttggggggaggggtgggcaattgaactggtgcctagagaaggtggggcttgggtaaactgggaaagtgatgtggtgtactggctccacctttttccccagggtgggggagaaccatatataagtgcagtagtctctgtgaacattcaagcttctgccttctccctcctgtgagtttggtaagtcactgactgtctatgcctgggaaagggtgggcaggagatggggcagtgcaggaaaagtggcactatgaaccctgcagccctagacaattgtactaaccttcttctctttcctctcctgacaggttggtgtacagtagcttccgtttaaacagccaccatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgattaattaataaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagctccataaagtaggaaacactacacgattccataaagtaggaaacactacatcactccataaagtaggaaacactacacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtacttaagcatggctacgtagataagtagcatggcgggttaatcattaactacacctgcaggaggaacccctagtgatggagttggccactccctctctgcgcgctcgctcgctcactgaggccgggcgaccaaaggtcgcccgacgcccgggcggcctcagtgagcgagcgagcgcgcagctgcctgcaggggcgcgccgctagcagctgatgcatagcatgcggtaccgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattgggaccaatacgcccgcgtttcttccttttccccaccccaacccccaagttcgggtgaaggcccagggctcgcagccaacgtcggggcggcaagccctgccatagccactacgggtacgtaggccaaccactagaactatagctagagtcctgggcgaacaaacgatgctcgccttccagaaaaccgaggatgcgaaccacttcatccggggtcagcaccaccggcaagcgccgcgacggccgaggtctaccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggccgcggagttgttcggtaaattgtcacaacgccgcgaatatagtctttaccatgcccttggccacgcccctctttaatacgacgggcaatttgcacttcagaaaatgaagagtttgctttagccataacaaaagtccagtatgctttttcacagcataactggactgatttcagtttacaactattctgtctagtttaagactttattgtcatagtttagatctattttgttcagtttaagactttattgtccgcccacacccgcttacgcagggcatccatttattactcaaccgtaaccgattttgccaggttacgcggctggtctgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcaaataagcgttgatattcagtcaattacaaacattaataacgaagagatgacagaaaaattttcattctgtgacagagaa

SEQ ID NO: 218 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 219-379 - skipped (161 entries)

SEQ ID NO: 380 - DNA, 4374 bp, Artificial Sequence
  Description of Artificial Sequence: Synthetic polynucleotide
atgcagattgagctgagcacctgcttcttcctgtgcctgctgaggttctgcttctctgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaaccccccagtgctgaagaggcaccagagggagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcacctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactga

SEQ ID NO: 381 - DNA, 4374 bp, Artificial Sequence
  Description of Artificial Sequence: Synthetic polynucleotide
atgcagattgagctgagcacctgcttcttcctgtgtctgctgaggttctgcttctctgccaccaggaggtattacctgggggctgtggagctgagctgggactatatgcagtctgacctgggggagctgcctgtggatgctaggttcccccccagggtgcccaagagcttcccctttaacacttctgtggtgtacaagaagaccctgtttgtggagttcactgaccacctgttcaacattgccaagcccaggcccccctggatggggctgctggggcccaccatccaggctgaggtgtatgacactgtggtgatcaccctgaagaacatggccagccaccctgtgagcctgcatgctgtgggggtgagctactggaaggcttctgagggggctgagtatgatgaccagactagccagagggagaaggaggatgacaaggtgtttcctgggggcagccatacctatgtgtggcaggtgctgaaggagaatggccccatggcctctgaccccctgtgcctgacctacagctacctgtctcatgtggacctggtgaaggacctgaactctggcctgattggggctctgctggtgtgtagggagggcagcctggctaaggaaaagacccagaccctgcataagtttatcctgctgtttgctgtgtttgatgagggcaagagctggcactctgagaccaagaacagcctgatgcaggatagggatgctgcctctgccagggcttggcctaagatgcacactgtgaatgggtatgtgaataggagcctgcctggcctgattggctgccacaggaagtctgtgtactggcatgtgattgggatgggcaccacccctgaggtccatagcatcttcctggagggccacactttcctggtgaggaaccacagacaggcctctctggagatctctcccatcaccttcctgactgctcagactctgctgatggacctgggccagttcctgctgttttgccatattagcagccaccagcatgatgggatggaggcctatgtgaaggtggatagctgccctgaggagcctcagctgaggatgaagaacaatgaggaggctgaagactatgatgatgacctgactgattctgagatggatgtggtgaggtttgatgatgacaatagccccagcttcattcagatcaggtctgtggccaagaaacaccccaagacctgggtgcactacattgctgctgaggaagaggactgggactatgctcccctggtgctggcccctgatgataggtcttataagagccagtacctgaacaatgggccccagaggattggcaggaagtacaagaaggtgaggttcatggcctacactgatgaaaccttcaaaaccagggaggccattcagcatgagtctggcatcctgggccctctgctgtatggggaggtgggggacaccctgctgatcatcttcaagaaccaggccagcaggccctacaacatctatcctcatggcatcactgatgtgaggcccctgtacagcaggaggctgcccaagggggtgaagcacctgaaagacttccccatcctgcctggggagatctttaagtataagtggactgtgactgtggaggatggccctaccaagtctgaccccaggtgtctgaccaggtactattctagctttgtgaacatggagagggacctggcctctggcctgattgggcccctgctgatctgctacaaggagtctgtggaccagaggggcaaccagatcatgtctgacaagaggaatgtgatcctgttttctgtgtttgatgagaataggagctggtacctgactgagaacatccagaggtttctgcccaatcctgctggggtgcagctggaggatcctgagttccaggccagcaatatcatgcatagcatcaatggctatgtgtttgacagcctgcagctgtctgtgtgcctgcatgaggtggcctactggtacatcctgagcattggggcccagactgactttctgtctgtgttcttttctggctataccttcaagcacaagatggtgtatgaggataccctgaccctgttccccttctctggggagactgtgttcatgagcatggagaatcctgggctgtggatcctggggtgccacaactctgattttaggaacagggggatgactgccctgctgaaggtgtctagctgtgataagaacactggggactactatgaggacagctatgaggacatttctgcttatctgctgtctaagaataatgccattgagcccagaagcttcagccagaatccccctgtgctgaagagacatcagagggagatcaccagaactaccctgcagtctgatcaggaggagattgactatgatgacactatctctgtggagatgaagaaggaggactttgacatctatgatgaggatgagaatcagtctcccaggagctttcagaagaagaccagacattacttcattgctgctgtggagaggctgtgggactatggcatgagctctagccctcatgtgctgaggaacagggcccagtctggctctgtgccccagttcaagaaggtggtgttccaggaattcactgatggcagcttcacccagcccctgtacaggggggagctgaatgagcacctgggcctgctggggccttatatcagggctgaggtggaggataatattatggtgactttcaggaaccaggccagcaggccctactctttctatagcagcctgatctcttatgaggaggatcagaggcagggggctgagcctaggaagaactttgtgaagcccaatgagactaagacctacttctggaaggtccagcaccacatggcccctaccaaggatgagtttgactgcaaggcctgggcctatttctctgatgtggatctggagaaggatgtccattctgggctgattggccccctgctggtgtgccacactaacactctgaatcctgcccatggcaggcaggtgactgtccaggagtttgccctgttcttcactatctttgatgagaccaagagctggtactttactgagaacatggagaggaactgcagagctccttgcaatattcagatggaggaccccaccttcaaggagaattacaggttccatgccattaatgggtacatcatggacaccctgcctggcctggtgatggctcaggaccagaggatcaggtggtacctgctgagcatgggctctaatgagaatatccacagcatccacttctctgggcatgtgttcactgtgaggaagaaggaggagtacaagatggctctgtataatctgtaccctggggtgtttgaaactgtggagatgctgccctctaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactattctggcagcatcaatgcctggagcaccaaggagcccttcagctggatcaaggtggacctgctggcccccatgatcattcatggcatcaagacccagggggccaggcagaagttcagctctctgtacatctctcagttcatcatcatgtactctctggatgggaagaagtggcagacctacaggggcaacagcactggcaccctgatggtgttctttgggaatgtggactcttctggcatcaagcacaacatcttcaatccccccatcattgctaggtatattaggctgcatcccacccactacagcatcaggtctaccctgaggatggagctgatgggctgtgacctgaactcttgcagcatgcccctgggcatggagtctaaggccatctctgatgcccagattactgccagcagctacttcaccaacatgtttgccacctggagcccctctaaggccaggctgcatctgcaggggaggagcaatgcctggaggcctcaggtgaacaaccccaaggagtggctgcaggtggatttccagaagaccatgaaggtgactggggtgaccacccagggggtcaagagcctgctgaccagcatgtatgtgaaggagttcctgatcagcagcagccaggatggccaccagtggactctgttctttcagaatgggaaggtgaaggtgtttcagggcaatcaggactctttcacccctgtggtgaacagcctggacccccccctgctgaccagatacctgaggatccacccccagtcttgggtgcatcagattgccctgaggatggaggtgctgggctgtgaggctcaggatctgtactga

SEQ ID NO: 382 - DNA, 4374 bp, Artificial Sequence
  Description of Artificial Sequence: Synthetic polynucleotide
atgcagatcgagctctccacctgcttctttctgtgcctgttgagattctgcttcagcgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaatccacccgtccttaagcgccatcagcgcgagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcatctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactga

SEQ ID NO: 383 - DNA, 7056 bp, Homo sapiens
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactga

SEQ ID NO: 384 - DNA, 4425 bp, Artificial Sequence
  Description of Artificial Sequence: Synthetic polynucleotide
atgcagattgagctgagcacctgcttcttcctgtgcctgctgaggttctgcttctctgccaccaggagatactacctgggggctgtggagctgagctgggactacatgcagtctgacctgggggagctgcctgtggatgccaggttcccccccagagtgcccaagagcttccccttcaacacctctgtggtgtacaagaagaccctgtttgtggagttcactgaccacctgttcaacattgccaagcccaggcccccctggatgggcctgctgggccccaccatccaggctgaggtgtatgacactgtggtgatcaccctgaagaacatggccagccaccctgtgagcctgcatgctgtgggggtgagctactggaaggcctctgagggggctgagtatgatgaccagaccagccagagggagaaggaggatgacaaggtgttccctgggggcagccacacctatgtgtggcaggtgctgaaggagaatggccccatggcctctgaccccctgtgcctgacctacagctacctgagccatgtggacctggtgaaggacctgaactctggcctgattggggccctgctggtgtgcagggagggcagcctggccaaggagaagacccagaccctgcacaagttcatcctgctgtttgctgtgtttgatgagggcaagagctggcactctgaaaccaagaacagcctgatgcaggacagggatgctgcctctgccagggcctggcccaagatgcacactgtgaatggctatgtgaacaggagcctgcctggcctgattggctgccacaggaagtctgtgtactggcatgtgattggcatgggcaccacccctgaggtgcacagcatcttcctggagggccacaccttcctggtcaggaaccacaggcaggccagcctggagatcagccccatcaccttcctgactgcccagaccctgctgatggacctgggccagttcctgctgttctgccacatcagcagccaccagcatgatggcatggaggcctatgtgaaggtggacagctgccctgaggagccccagctgaggatgaagaacaatgaggaggctgaggactatgatgatgacctgactgactctgagatggatgtggtgaggtttgatgatgacaacagccccagcttcatccagatcaggtctgtggccaagaagcaccccaagacctgggtgcactacattgctgctgaggaggaggactgggactatgcccccctggtgctggcccctgatgacaggagctacaagagccagtacctgaacaatggcccccagaggattggcaggaagtacaagaaggtcaggttcatggcctacactgatgaaaccttcaagaccagggaggccatccagcatgagtctggcatcctgggccccctgctgtatggggaggtgggggacaccctgctgatcatcttcaagaaccaggccagcaggccctacaacatctacccccatggcatcactgatgtgaggcccctgtacagcaggaggctgcccaagggggtgaagcacctgaaggacttccccatcctgcctggggagatcttcaagtacaagtggactgtgactgtggaggatggccccaccaagtctgaccccaggtgcctgaccagatactacagcagctttgtgaacatggagagggacctggcctctggcctgattggccccctgctgatctgctacaaggagtctgtggaccagaggggcaaccagatcatgtctgacaagaggaatgtgatcctgttctctgtgtttgatgagaacaggagctggtacctgactgagaacatccagaggttcctgcccaaccctgctggggtgcagctggaggaccctgagttccaggccagcaacatcatgcacagcatcaatggctatgtgtttgacagcctgcagctgtctgtgtgcctgcatgaggtggcctactggtacatcctgagcattggggcccagactgacttcctgtctgtgttcttctctggctacaccttcaagcacaagatggtgtatgaggacaccctgaccctgttccccttctctggggagactgtgttcatgagcatggagaaccctggcctgtggattctgggctgccacaactctgacttcaggaacaggggcatgactgccctgctgaaagtctccagctgtgacaagaacactggggactactatgaggacagctatgaggacatctctgcctacctgctgagcaagaacaatgccattgagcccaggagcttcagccagaatgccactaatgtgtctaacaacagcaacaccagcaatgacagcaatgtgtctcccccagtgctgaagaggcaccagagggagatcaccaggaccaccctgcagtctgaccaggaggagattgactatgatgacaccatctctgtggagatgaagaaggaggactttgacatctacgacgaggacgagaaccagagccccaggagcttccagaagaagaccaggcactacttcattgctgctgtggagaggctgtgggactatggcatgagcagcagcccccatgtgctgaggaacagggcccagtctggctctgtgccccagttcaagaaggtggtgttccaggagttcactgatggcagcttcacccagcccctgtacagaggggagctgaatgagcacctgggcctgctgggcccctacatcagggctgaggtggaggacaacatcatggtgaccttcaggaaccaggccagcaggccctacagcttctacagcagcctgatcagctatgaggaggaccagaggcagggggctgagcccaggaagaactttgtgaagcccaatgaaaccaagacctacttctggaaggtgcagcaccacatggcccccaccaaggatgagtttgactgcaaggcctgggcctacttctctgatgtggacctggagaaggatgtgcactctggcctgattggccccctgctggtgtgccacaccaacaccctgaaccctgcccatggcaggcaggtgactgtgcaggagtttgccctgttcttcaccatctttgatgaaaccaagagctggtacttcactgagaacatggagaggaactgcagggccccctgcaacatccagatggaggaccccaccttcaaggagaactacaggttccatgccatcaatggctacatcatggacaccctgcctggcctggtgatggcccaggaccagaggatcaggtggtacctgctgagcatgggcagcaatgagaacatccacagcatccacttctctggccatgtgttcactgtgaggaagaaggaggagtacaagatggccctgtacaacctgtaccctggggtgtttgagactgtggagatgctgcccagcaaggctggcatctggagggtggagtgcctgattggggagcacctgcatgctggcatgagcaccctgttcctggtgtacagcaacaagtgccagacccccctgggcatggcctctggccacatcagggacttccagatcactgcctctggccagtatggccagtgggcccccaagctggccaggctgcactactctggcagcatcaatgcctggagcaccaaggagcccttcagctggatcaaggtggacctgctggcccccatgatcatccatggcatcaagacccagggggccaggcagaagttcagcagcctgtacatcagccagttcatcatcatgtacagcctggatggcaagaagtggcagacctacaggggcaacagcactggcaccctgatggtgttctttggcaatgtggacagctctggcatcaagcacaacatcttcaacccccccatcattgccagatacatcaggctgcaccccacccactacagcatcaggagcaccctgaggatggagctgatgggctgtgacctgaacagctgcagcatgcccctgggcatggagagcaaggccatctctgatgcccagatcactgccagcagctacttcaccaacatgtttgccacctggagccccagcaaggccaggctgcacctgcagggcaggagcaatgcctggaggccccaggtcaacaaccccaaggagtggctgcaggtggacttccagaagaccatgaaggtgactggggtgaccacccagggggtgaagagcctgctgaccagcatgtatgtgaaggagttcctgatcagcagcagccaggatggccaccagtggaccctgttcttccagaatggcaaggtgaaggtgttccagggcaaccaggacagcttcacccctgtggtgaacagcctggacccccccctgctgaccagatacctgaggattcacccccagagctgggtgcaccagattgccctgaggatggaggtgctgggctgtgaggcccaggacctgtactga

SEQ ID NO: 385 - protein, 1474 aa, Artificial Sequence [sequence omitted]

SEQ ID NO: 386 - DNA, 5052 bp, Artificial Sequence
  Description of Artificial Sequence: Synthetic polynucleotide
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacgacaaaactcacacatgcccaccgtgcccagctccagaactcctgggcggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgttggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 387 - DNA, 4374 bp, Artificial Sequence
  Description of Artificial Sequence: Synthetic polynucleotide
atgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcctcggagcttcagccagaatcctcctgtgctgaagcggcaccagcgcgagatcaccagaacaaccctgcagagcgaccaagaggaaatcgattacgacgacaccatcagcgtcgagatgaagaaagaagatttcgacatctacgacgaggacgagaatcagagccccagaagctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatcagctacgaagaggaccagagacagggcgctgagcccagaaagaacttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagagccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtacagcaacaagtgtcagacccctctcggcatggcctctggacacatcagagacttccagatcaccgcctctggccagtacggacagtgggctcctaaactggctcggctgcactacagcggcagcatcaatgcctggtccaccaaagagcccttcagctggatcaaggtggacctgctggctcccatgatcatccacggaatcaagacccagggcgccagacagaagttcagcagcctgtacatcagccagttcatcatcatgtacagcctggacggcaagaagtggcagacctacagaggcaacagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgatctccagcagccaggacggccatcagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactag

SEQ ID NO: 388 - DNA, 4980 bp, Artificial Sequence
  Description of Artificial Sequence: Synthetic polynucleotide
atgcagatcgagctgagcacctgcttcttcctgtgcctgctgcgcttctgcttcagcgccacccgccgctactacctgggcgccgtggagctgagctgggactacatgcagagcgacctgggcgagctgcccgtggacgcccgcttccccccccgcgtgcccaagagcttccccttcaacaccagcgtggtgtacaagaagaccctgttcgtggagttcaccgaccacctgttcaacatcgccaagccccgccccccctggatgggcctgctgggccccaccatccaggccgaggtgtacgacaccgtggtgatcaccctgaagaacatggccagccaccccgtgagcctgcacgccgtgggcgtgagctactggaaggccagcgagggcgccgagtacgacgaccagaccagccagcgcgagaaggaggacgacaaggtgttccccggcggcagccacacctacgtgtggcaggtgctgaaggagaacggccccatggccagcgaccccctgtgcctgacctacagctacctgagccacgtggacctggtgaaggacctgaacagcggcctgatcggcgccctgctggtgtgccgcgagggcagcctggccaaggagaagacccagaccctgcacaagttcatcctgctgttcgccgtgttcgacgagggcaagagctggcacagcgagaccaagaacagcctgatgcaggaccgcgacgccgccagcgcccgcgcctggcccaagatgcacaccgtgaacggctacgtgaaccgcagcctgcccggcctgatcggctgccaccgcaagagcgtgtactggcacgtgatcggcatgggcaccacccccgaggtgcacagcatcttcctggagggccacaccttcctggtgcgcaaccaccgccaggccagcctggagatcagccccatcaccttcctgaccgcccagaccctgctgatggacctgggccagttcctgctgttctgccacatcagcagccaccagcacgacggcatggaggcctacgtgaaggtggacagctgccccgaggagccccagctgcgcatgaagaacaacgaggaggccgaggactacgacgacgacctgaccgacagcgagatggacgtggtgcgcttcgacgacgacaacagccccagcttcatccagatccgcagcgtggccaagaagcaccccaagacctgggtgcactacatcgccgccgaggaggaggactgggactacgcccccctggtgctggcccccgacgaccgcagctacaagagccagtacctgaacaacggcccccagcgcatcggccgcaagtacaagaaggtgcgcttcatggcctacaccgacgagaccttcaagacccgcgaggccatccagcacgagagcggcatcctgggccccctgctgtacggcgaggtgggcgacaccctgctgatcatcttcaagaaccaggccagccgcccctacaacatctacccccacggcatcaccgacgtgcgccccctgtacagccgccgcctgcccaagggcgtgaagcacctgaaggacttccccatcctgcccggcgagatcttcaagtacaagtggaccgtgaccgtggaggacggccccaccaagagcgacccccgctgcctgacccgctactacagcagcttcgtgaacatggagcgcgacctggccagcggcctgatcggccccctgctgatctgctacaaggagagcgtggaccagcgcggcaaccagatcatgagcgacaagcgcaacgtgatcctgttcagcgtgttcgacgagaaccgcagctggtacctgaccgagaacatccagcgcttcctgcccaaccccgccggcgtgcagctggaggaccccgagttccaggccagcaacatcatgcacagcatcaacggctacgtgttcgacagcctgcagctgagcgtgtgcctgcacgaggtggcctactggtacatcctgagcatcggcgcccagaccgacttcctgagcgtgttcttcagcggctacaccttcaagcacaagatggtgtacgaggacaccctgaccctgttccccttcagcggcgagaccgtgttcatgagcatggagaaccccggcctgtggatcctgggctgccacaacagcgacttccgcaaccgcggcatgaccgccctgctgaaggtgagcagctgcgacaagaacaccggcgactactacgaggacagctacgaggacatcagcgcctacctgctgagcaagaacaacgccatcgagccccgcagcttcagccagaacagccgccaccccagcacccgccagaagcagttcaacgccaccaccatccccgagaacgacatcgagaagaccgacccctggttcgcccaccgcacccccatgcccaagatccagaacgtgagcagcagcgacctgctgatgctgctgcgccagagccccaccccccacggcctgagcctgagcgacctgcaagaggccaagtacgagaccttcagcgacgaccccagccccggcgccatcgacagcaacaacagcctgagcgagatgacccacttccgcccccagctgcaccacagcggcgacatggtgttcacccccgagagcggcctgcagctgcgcctgaacgagaagctgggcaccaccgccgccaccgagctgaagaagctggacttcaaggtgagcagcaccagcaacaacctgatcagcaccatccccagcgacaacctggccgccggcaccgacaacaccagcagcctgggcccccccagcatgcccgtgcactacgacagccagctggacaccaccctgttcggcaagaagagcagccccctgaccgagagcggcggccccctgagcctgagcgaggagaacaacgacagcaagctgccccccgtgctgaagcgccaccagcgcgagatcacccgcaccaccctgcagagcgaccaggaggagatcgactacgacgacaccatcagcgtggagatgaagaaggaggacttcgacatctacgacgaggacgagaaccagagcccccgcagcttccagaagaagacccgccactacttcatcgccgccgtggagcgcctgtgggactacggcatgagcagcagcccccacgtgctgcgcaaccgcgcccagagcggcagcgtgccccagttcaagaaggtggtgttccaggagttcaccgacggcagcttcacccagcccctgtaccgcggcgagctgaacgagcacctgggcctgctgggcccctacatccgcgccgaggtggaggacaacatcatggtgaccttccgcaaccaggccagccgcccctacagcttctacagcagcctgatcagctacgaggaggaccagcgccagggcgccgagccccgcaagaacttcgtgaagcccaacgagaccaagacctacttctggaaggtgcagcaccacatggcccccaccaaggacgagttcgactgcaaggcctgggcctacttcagcgacgtggacctggagaaggacgtgcacagcggcctgatcggccccctgctggtgtgccacaccaacaccctgaaccccgcccacggccgccaggtgaccgtgcaggagttcgccctgttcttcaccatcttcgacgagaccaagagctggtacttcaccgagaacatggagcgcaactgccgcgccccctgcaacatccagatggaggaccccaccttcaaggagaactaccgcttccacgccatcaacggctacatcatggacaccctgcccggcctggtgatggcccaggaccagcgcatccgctggtacctgctgagcatgggcagcaacgagaacatccacagcatccacttcagcggccacgtgttcaccgtgcgcaagaaggaggagtacaagatggccctgtacaacctgtaccccggcgtgttcgagaccgtggagatgctgcccagcaaggccggcatctggcgcgtggagtgcctgatcggcgagcacctgcacgccggcatgagcaccctgttcctggtgtacagcaacaagtgccagacccccctgggcatggccagcggccacatccgcgacttccagatcaccgccagcggccagtacggccagtgggcccccaagctggcccgcctgcactacagcggcagcatcaacgcctggagcaccaaggagcccttcagctggatcaaggtggacctgctggcccccatgatcatccacggcatcaagacccagggcgcccgccagaagttcagcagcctgtacatcagccagttcatcatcatgtacagcctggacggcaagaagtggcagacctaccgcggcaacagcaccggcaccctgatggtgttcttcggcaacgtggacagcagcggcatcaagcacaacatcttcaacccccccatcatcgcccgctacatccgcctgcaccccacccactacagcatccgcagcaccctgcgcatggagctgatgggctgcgacctgaacagctgcagcatgcccctgggcatggagagcaaggccatcagcgacgcccagatcaccgccagcagctacttcaccaacatgttcgccacctggagccccagcaaggcccgcctgcacctgcaaggccgcagcaacgcctggcgcccccaggtgaacaaccccaaggagtggctgcaggtggacttccagaagaccatgaaggtgaccggcgtgaccacccagggcgtgaagagcctgctgaccagcatgtacgtgaaggagttcctgatcagcagcagccaggacggccaccagtggaccctgttcttccagaacggcaaggtgaaggtgttccagggcaaccaggacagcttcacccccgtggtgaacagcctggacccccccctgctgacccgctacctgcgcatccacccccagagctgggtgcaccagatcgccctgcgcatggaggtgctgggctgcgaggcccaggacctgtactaa

SEQ ID NO: 389 - DNA, 7056 bp, Artificial Sequence
  Description of Artificial Sequence: Synthetic polynucleotide
atgcagatcgagctgagcacctgcttcttcctgtgcctgctgcgcttctgcttcagcgccacccgccgctactacctgggcgccgtggagctgagctgggactacatgcagagcgacctgggcgagctgcccgtggacgcccgcttccccccccgcgtgcccaagagcttccccttcaacaccagcgtggtgtacaagaagaccctgttcgtggagttcaccgaccacctgttcaacatcgccaagccccgccccccctggatgggcctgctgggccccaccatccaggccgaggtgtacgacaccgtggtgatcaccctgaagaacatggccagccaccccgtgagcctgcacgccgtgggcgtgagctactggaaggccagcgagggcgccgagtacgacgaccagaccagccagcgcgagaaggaggacgacaaggtgttccccggcggcagccacacctacgtgtggcaggtgctgaaggagaacggccccatggccagcgaccccctgtgcctgacctacagctacctgagccacgtggacctggtgaaggacctgaacagcggcctgatcggcgccctgctggtgtgccgcgagggcagcctggccaaggagaagacccagaccctgcacaagttcatcctgctgttcgccgtgttcgacgagggcaagagctggcacagcgagaccaagaacagcctgatgcaggaccgcgacgccgccagcgcccgcgcctggcccaagatgcacaccgtgaacggctacgtgaaccgcagcctgcccggcctgatcggctgccaccgcaagagcgtgtactggcacgtgatcggcatgggcaccacccccgaggtgcacagcatcttcctggagggccacaccttcctggtgcgcaaccaccgccaggccagcctggagatcagccccatcaccttcctgaccgcccagaccctgctgatggacctgggccagttcctgctgttctgccacatcagcagccaccagcacgacggcatggaggcctacgtgaaggtggacagctgccccgaggagccccagctgcgcatgaagaacaacgaggaggccgaggactacgacgacgacctgaccgacagcgagatggacgtggtgcgcttcgacgacgacaacagccccagcttcatccagatccgcagcgtggccaagaagcaccccaagacctgggtgcactacatcgccgccgaggaggaggactgggactacgcccccctggtgctggcccccgacgaccgcagctacaagagccagtacctgaacaacggcccccagcgcatcggccgcaagtacaagaaggtgcgcttcatggcctacaccgacgagaccttcaagacccgcgaggccatccagcacgagagcggcatcctgggccccctgctgtacggcgaggtgggcgacaccctgctgatcatcttcaagaaccaggccagccgcccctacaacatctacccccacggcatcaccgacgtgcgccccctgtacagccgccgcctgcccaagggcgtgaagcacctgaaggacttccccatcctgcccggcgagatcttcaagtacaagtggaccgtgaccgtggaggacggccccaccaagagcgacccccgctgcctgacccgctactacagcagcttcgtgaacatggagcgcgacctggccagcggcctgatcggccccctgctgatctgctacaaggagagcgtggaccagcgcggcaaccagatcatgagcgacaagcgcaacgtgatcctgttcagcgtgttcgacgagaaccgcagctggtacctgaccgagaacatccagcgcttcctgcccaaccccgccggcgtgcagctggaggaccccgagttccaggccagcaacatcatgcacagcatcaacggctacgtgttcgacagcctgcagctgagcgtgtgcctgcacgaggtggcctactggtacatcctgagcatcggcgcccagaccgacttcctgagcgtgttcttcagcggctacaccttcaagcacaagatggtgtacgaggacaccctgaccctgttccccttcagcggcgagaccgtgttcatgagcatggagaaccccggcctgtggatcctgggctgccacaacagcgacttccgcaaccgcggcatgaccgccctgctgaaggtgagcagctgcgacaagaacaccggcgactactacgaggacagctacgaggacatcagcgcctacctgctgagcaagaacaacgccatcgagccccgcagcttcagccagaacagccgccaccccagcacccgccagaagcagttcaacgccaccaccatccccgagaacgacatcgagaagaccgacccctggttcgcccaccgcacccccatgcccaagatccagaacgtgagcagcagcgacctgctgatgctgctgcgccagagccccaccccccacggcctgagcctgagcgacctgcaagaggccaagtacgagaccttcagcgacgaccccagccccggcgccatcgacagcaacaacagcctgagcgagatgacccacttccgcccccagctgcaccacagcggcgacatggtgttcacccccgagagcggcctgcagctgcgcctgaacgagaagctgggcaccaccgccgccaccgagctgaagaagctggacttcaaggtgagcagcaccagcaacaacctgatcagcaccatccccagcgacaacctggccgccggcaccgacaacaccagcagcctgggcccccccagcatgcccgtgcactacgacagccagctggacaccaccctgttcggcaagaagagcagccccctgaccgagagcggcggccccctgagcctgagcgaggagaacaacgacagcaagctgctggagagcggcctgatgaacagccaggagagcagctggggcaagaacgtgagcagcaccgagagcggcaggctgttcaagggcaagcgcgcccacggccccgccctgctgaccaaggacaacgccctgttcaaggtgagcatcagcctgctgaagaccaacaagaccagcaacaacagcgccaccaaccgcaagacccacatcgacggccccagcctgctgatcgagaacagccccagcgtgtggcagaacatcctggagagcgacaccgagttcaagaaggtgacccccctgatccacgaccgcatgctgatggacaagaacgccaccgccctgcgcctgaaccacatgagcaacaagaccaccagcagcaagaacatggagatggtgcagcagaagaaggagggccccatcccccccgacgcccagaaccccgacatgagcttcttcaagatgctgttcctgcccgagagcgcccgctggatccagcgcacccacggcaagaacagcctgaacagcggccagggccccagccccaagcagctggtgagcctgggccccgagaagagcgtggagggccagaacttcctgagcgagaagaacaaggtggtggtgggcaagggcgagttcaccaaggacgtgggcctgaaggagatggtgttccccagcagccgcaacctgttcctgaccaacctggacaacctgcacgagaacaacacccacaaccaggagaagaagatccaggaggagatcgagaagaaggagaccctgatccaggagaacgtggtgctgccccagatccacaccgtgaccggcaccaagaacttcatgaagaacctgttcctgctgagcacccgccagaacgtggagggcagctacgacggcgcctacgcccccgtgctgcaggacttccgcagcctgaacgacagcaccaaccgcaccaagaagcacaccgcccacttcagcaagaagggcgaggaggagaacctggagggcctgggcaaccagaccaagcagatcgtggagaagtacgcctgcaccacccgcatcagccccaacaccagccagcagaacttcgtgacccagcgcagcaagcgcgccctgaagcagttccgcctgcccctggaggagaccgagctggagaagcgcatcatcgtggacgacaccagcacccagtggagcaagaacatgaagcacctgacccccagcaccctgacccagatcgactacaacgagaaggagaagggcgccatcacccagagccccctgagcgactgcctgacccgcagccacagcatcccccaggccaaccgcagccccctgcccatcgccaaggtgagcagcttccccagcatccgccccatctacctgacccgcgtgctgttccaggacaacagcagccacctgcccgccgccagctaccgcaagaaggacagcggcgtgcaggagagcagccacttcctgcaaggcgccaagaagaacaacctgagcctggccatcctgaccctggagatgaccggcgaccagcgcgaggtgggcagcctgggcaccagcgccaccaacagcgtgacctacaagaaggtggagaacaccgtgctgcccaagcccgacctgcccaagaccagcggcaaggtggagctgctgcccaaggtgcacatctaccagaaggacctgttccccaccgagaccagcaacggcagccccggccacctggacctggtggagggcagcctgctgcagggcaccgagggcgccatcaagtggaacgaggccaaccgccccggcaaggtgcccttcctgcgcgtggccaccgagagcagcgccaagacccccagcaagctgctggaccccctggcctgggacaaccactacggcacccagatccccaaggaggagtggaagagccaggagaagagccccgagaagaccgccttcaagaagaaggacaccatcctgagcctgaacgcctgcgagagcaaccacgccatcgccgccatcaacgagggccagaacaagcccgagatcgaggtgacctgggccaagcagggccgcaccgagcgcctgtgcagccagaacccccccgtgctgaagcgccaccagcgcgagatcacccgcaccaccctgcagagcgaccaggaggagatcgactacgacgacaccatcagcgtggagatgaagaaggaggacttcgacatctacgacgaggacgagaaccagagcccccgcagcttccagaagaagacccgccactacttcatcgccgccgtggagcgcctgtgggactacggcatgagcagcagcccccacgtgctgcgcaaccgcgcccagagcggcagcgtgccccagttcaagaaggtggtgttccaggagttcaccgacggcagcttcacccagcccctgtaccgcggcgagctgaacgagcacctgggcctgctgggcccctacatccgcgccgaggtggaggacaacatcatggtgaccttccgcaaccaggccagccgcccctacagcttctacagcagcctgatcagctacgaggaggaccagcgccagggcgccgagccccgcaagaacttcgtgaagcccaacgagaccaagacctacttctggaaggtgcagcaccacatggcccccaccaaggacgagttcgactgcaaggcctgggcctacttcagcgacgtggacctggagaaggacgtgcacagcggcctgatcggccccctgctggtgtgccacaccaacaccctgaaccccgcccacggccgccaggtgaccgtgcaggagttcgccctgttcttcaccatcttcgacgagaccaagagctggtacttcaccgagaacatggagcgcaactgccgcgccccctgcaacatccagatggaggaccccaccttcaaggagaactaccgcttccacgccatcaacggctacatcatggacaccctgcccggcctggtgatggcccaggaccagcgcatccgctggtacctgctgagcatgggcagcaacgagaacatccacagcatccacttcagcggccacgtgttcaccgtgcgcaagaaggaggagtacaagatggccctgtacaacctgtaccccggcgtgttcgagaccgtggagatgctgcccagcaaggccggcatctggcgcgtggagtgcctgatcggcgagcacctgcacgccggcatgagcaccctgttcctggtgtacagcaacaagtgccagacccccctgggcatggccagcggccacatccgcgacttccagatcaccgccagcggccagtacggccagtgggcccccaagctggcccgcctgcactacagcggcagcatcaacgcctggagcaccaaggagcccttcagctggatcaaggtggacctgctggcccccatgatcatccacggcatcaagacccagggcgcccgccagaagttcagcagcctgtacatcagccagttcatcatcatgtacagcctggacggcaagaagtggcagacctaccgcggcaacagcaccggcaccctgatggtgttcttcggcaacgtggacagcagcggcatcaagcacaacatcttcaacccccccatcatcgcccgctacatccgcctgcaccccacccactacagcatccgcagcaccctgcgcatggagctgatgggctgcgacctgaacagctgcagcatgcccctgggcatggagagcaaggccatcagcgacgcccagatcaccgccagcagctacttcaccaacatgttcgccacctggagccccagcaaggcccgcctgcacctgcaaggccgcagcaacgcctggcgcccccaggtgaacaaccccaaggagtggctgcaggtggacttccagaagaccatgaaggtgaccggcgtgaccacccagggcgtgaagagcctgctgaccagcatgtacgtgaaggagttcctgatcagcagcagccaggacggccaccagtggaccctgttcttccagaacggcaaggtgaaggtgttccagggcaaccaggacagcttcacccccgtggtgaacagcctggacccccccctgctgacccgctacctgcgcatccacccccagagctgggtgcaccagatcgccctgcgcatggaggtgctgggctgcgaggcccaggacctgtactaa

SEQ ID NO: 390 - DNA, 4374 bp, Artificial Sequence
  Description of Artificial Sequence: Synthetic polynucleotide
atgcagatcgagctgagcacctgcttcttcctgtgcctgctgcgcttctgcttcagcgccacccgccgctactacctgggcgccgtggagctgagctgggactacatgcagagcgacctgggcgagctgcccgtggacgcccgcttccccccccgcgtgcccaagagcttccccttcaacaccagcgtggtgtacaagaagaccctgttcgtggagttcaccgaccacctgttcaacatcgccaagccccgccccccctggatgggcctgctgggccccaccatccaggccgaggtgtacgacaccgtggtgatcaccctgaagaacatggccagccaccccgtgagcctgcacgccgtgggcgtgagctactggaaggccagcgagggcgccgagtacgacgaccagaccagccagcgcgagaaggaggacgacaaggtgttccccggcggcagccacacctacgtgtggcaggtgctgaaggagaacggccccatggccagcgaccccctgtgcctgacctacagctacctgagccacgtggacctggtgaaggacctgaacagcggcctgatcggcgccctgctggtgtgccgcgagggcagcctggccaaggagaagacccagaccctgcacaagttcatcctgctgttcgccgtgttcgacgagggcaagagctggcacagcgagaccaagaacagcctgatgcaggaccgcgacgccgccagcgcccgcgcctggcccaagatgcacaccgtgaacggctacgtgaaccgcagcctgcccggcctgatcggctgccaccgcaagagcgtgtactggcacgtgatcggcatgggcaccacccccgaggtgcacagcatcttcctggagggccacaccttcctggtgcgcaaccaccgccaggccagcctggagatcagccccatcaccttcctgaccgcccagaccctgctgatggacctgggccagttcctgctgttctgccacatcagcagccaccagcacgacggcatggaggcctacgtgaaggtggacagctgccccgaggagccccagctgcgcatgaagaacaacgaggaggccgaggactacgacgacgacctgaccgacagcgagatggacgtggtgcgcttcgacgacgacaacagccccagcttcatccagatccgcagcgtggccaagaagcaccccaagacctgggtgcactacatcgccgccgaggaggaggactgggactacgcccccctggtgctggcccccgacgaccgcagctacaagagccagtacctgaacaacggcccccagcgcatcggccgcaagtacaagaaggtgcgcttcatggcctacaccgacgagaccttcaagacccgcgaggccatccagcacgagagcggcatcctgggccccctgctgtacggcgaggtgggcgacaccctgctgatcatcttcaagaaccaggccagccgcccctacaacatctacccccacggcatcaccgacgtgcgccccctgtacagccgccgcctgcccaagggcgtgaagcacctgaaggacttccccatcctgcccggcgagatcttcaagtacaagtggaccgtgaccgtggaggacggccccaccaagagcgacccccgctgcctgacccgctactacagcagcttcgtgaacatggagcgcgacctggccagcggcctgatcggccccctgctgatctgctacaaggagagcgtggaccagcgcggcaaccagatcatgagcgacaagcgcaacgtgatcctgttcagcgtgttcgacgagaaccgcagctggtacctgaccgagaacatccagcgcttcctgcccaaccccgccggcgtgcagctggaggaccccgagttccaggccagcaacatcatgcacagcatcaacggctacgtgttcgacagcctgcagctgagcgtgtgcctgcacgaggtggcctactggtacatcctgagcatcggcgcccagaccgacttcctgagcgtgttcttcagcggctacaccttcaagcacaagatggtgtacgaggacaccctgaccctgttccccttcagcggcgagaccgtgttcatgagcatggagaaccccggcctgtggatcctgggctgccacaacagcgacttccgcaaccgcggcatgaccgccctgctgaaggtgagcagctgcgacaagaacaccggcgactactacgaggacagctacgaggacatcagcgcctacctgctgagcaagaacaacgccatcgagccccgcagcttcagccagaacccccccgtgctgaagcgccaccagcgcgagatcacccgcaccaccctgcagagcgaccaggaggagatcgactacgacgacaccatcagcgtggagatgaagaaggaggacttcgacatctacgacgaggacgagaaccagagcccccgcagcttccagaagaagacccgccactacttcatcgccgccgtggagcgcctgtgggactacggcatgagcagcagcccccacgtgctgcgcaaccgcgcccagagcggcagcgtgccccagttcaagaaggtggtgttccaggagttcaccgacggcagcttcacccagcccctgtaccgcggcgagctgaacgagcacctgggcctgctgggcccctacatccgcgccgaggtggaggacaacatcatggtgaccttccgcaaccaggccagccgcccctacagcttctacagcagcctgatcagctacgaggaggaccagcgccagggcgccgagccccgcaagaacttcgtgaagcccaacgagaccaagacctacttctggaaggtgcagcaccacatggcccccaccaaggacgagttcgactgcaaggcctgggcctacttcagcgacgtggacctggagaaggacgtgcacagcggcctgatcggccccctgctggtgtgccacaccaacaccctgaaccccgcccacggccgccaggtgaccgtgcaggagttcgccctgttcttcaccatcttcgacgagaccaagagctggtacttcaccgagaacatggagcgcaactgccgcgccccctgcaacatccagatggaggaccccaccttcaaggagaactaccgcttccacgccatcaacggctacatcatggacaccctgcccggcctggtgatggcccaggaccagcgcatccgctggtacctgctgagcatgggcagcaacgagaacatccacagcatccacttcagcggccacgtgttcaccgtgcgcaagaaggaggagtacaagatggccctgtacaacctgtaccccggcgtgttcgagaccgtggagatgctgcccagcaaggccggcatctggcgcgtggagtgcctgatcggcgagcacctgcacgccggcatgagcaccctgttcctggtgtacagcaacaagtgccagacccccctgggcatggccagcggccacatccgcgacttccagatcaccgccagcggccagtacggccagtgggcccccaagctggcccgcctgcactacagcggcagcatcaacgcctggagcaccaaggagcccttcagctggatcaaggtggacctgctggcccccatgatcatccacggcatcaagacccagggcgcccgccagaagttcagcagcctgtacatcagccagttcatcatcatgtacagcctggacggcaagaagtggcagacctaccgcggcaacagcaccggcaccctgatggtgttcttcggcaacgtggacagcagcggcatcaagcacaacatcttcaacccccccatcatcgcccgctacatccgcctgcaccccacccactacagcatccgcagcaccctgcgcatggagctgatgggctgcgacctgaacagctgcagcatgcccctgggcatggagagcaaggccatcagcgacgcccagatcaccgccagcagctacttcaccaacatgttcgccacctggagccccagcaaggcccgcctgcacctgcaaggccgcagcaacgcctggcgcccccaggtgaacaaccccaaggagtggctgcaggtggacttccagaagaccatgaaggtgaccggcgtgaccacccagggcgtgaagagcctgctgaccagcatgtacgtgaaggagttcctgatcagcagcagccaggacggccaccagtggaccctgttcttccagaacggcaaggtgaaggtgttccagggcaaccaggacagcttcacccccgtggtgaacagcctggacccccccctgctgacccgctacctgcgcatccacccccagagctgggtgcaccagatcgccctgcgcatggaggtgctgggctgcgaggcccaggacctgtactaa

SEQ ID NO: 391 - DNA, 7056 bp, Artificial Sequence
  Description of Artificial Sequence: Synthetic polynucleotide
atgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcccagaagcttcagccagaatagcagacacccctccaccagacagaagcagttcaacgccacaacaatccccgagaacgacatcgagaaaaccgatccttggtttgcccacagaacccctatgcctaagatccagaacgtgtcctccagcgatctgctgatgctcctgagacagagccctacacctcacggactgagcctgtccgatctgcaagaggccaaatacgaaaccttcagcgacgacccttctcctggcgccatcgacagcaacaatagcctgagcgagatgacccacttcagaccacagctgcaccacagcggcgacatggtgtttacacctgagagcggcctccagctgagactgaatgagaagctgggaaccaccgccgccaccgagctgaagaaactggacttcaaggtgtcctctaccagcaacaacctgatcagcacaatcccctccgacaacctggctgccggcaccgacaacacatcttctctgggcccacctagcatgcccgtgcactacgatagccagctggataccacactgttcggcaagaagtctagccctctgacagagtctggcggccctctgtctctgagcgaggaaaacaacgacagcaagctgctggaatccggcctgatgaacagccaagagtcctcctggggcaagaatgtgtccagcaccgagtccggcagactgttcaagggaaagagagcccacggacctgctctgctgaccaaggataacgccctgttcaaagtgtccatcagcctgctcaagaccaacaagacctccaacaactccgccaccaacagaaagacccacatcgacggccctagcctgctgatcgagaatagccctagcgtctggcagaatatcctggaaagcgacaccgagttcaagaaagtgacccctctgatccacgaccggatgctcatggacaagaacgccaccgctctgcggctgaaccacatgagcaacaagacaaccagcagcaagaatatggaaatggtgcagcagaagaaagagggccccattcctccagacgctcagaaccccgatatgagcttcttcaagatgctctttctgcccgagagcgcccggtggattcagagaacacacggcaagaactccctgaactccggccagggaccttctccaaagcagctggtttccctgggacctgagaagtccgtggaaggacagaacttcctgagcgaaaagaacaaagtggtcgtcggcaagggcgagttcaccaaggatgtgggcctgaaagagatggtctttcccagcagccggaacctgttcctgaccaacctggacaacctgcacgagaacaacacccacaatcaagagaagaagatccaagaggaaatcgaaaagaaagagacactcatccaagagaacgtggtgctgcctcagatccacacagtgaccggcaccaagaactttatgaagaatctgttcctgctgagtacccggcagaacgtggaaggcagctacgatggcgcttatgcccctgtgctgcaggacttcagatccctgaacgactccaccaatcggacaaagaagcacacagcccacttctccaagaagggcgaagaagagaacctggaaggactgggcaatcagaccaagcagatcgtcgagaagtacgcctgcaccaccagaatcagccccaacacaagccagcagaacttcgtgacccagcggagcaaaagagccctgaagcagtttcggctgcccctggaagaaaccgagctggaaaagcggatcatcgtggacgacaccagcacacagtggtccaagaacatgaagcacttgacccctagcacactgacccagatcgactacaacgagaaagagaagggcgctatcacacagagcccactgagcgactgtctgaccagaagccacagcatccctcaggccaacagatcccctctgccaatcgccaaagtgtctagcttccccagcatcagacccatctacctgaccagagtgctgttccaggacaacagcagccatctgccagccgccagctaccggaagaaagattctggcgtgcaagagagcagccactttctgcagggcgctaagaagaacaatctgagcctggctattctgaccctggaaatgaccggcgatcagagagaagtcggctctctgggcaccagcgccacaaatagcgtgacctacaaaaaggtggaaaacaccgtgctgcctaagcctgacctgccaaagacaagcggcaaggtggaactgctgccaaaggtgcacatctaccagaaggacctgtttcctaccgagacaagcaacggctctcccggccatctggatctggtggaaggatctctgctgcagggaaccgagggcgccatcaagtggaacgaggccaatagacctggcaaggtgcccttcctgagagtggccacagagtccagcgccaagacaccctctaaactgctggaccctctggcctgggacaaccactatggcactcagatccccaaagaggaatggaagtcccaagagaagtcccctgaaaagaccgccttcaagaagaaggacaccattctgtccctgaatgcctgcgagagcaaccacgccattgccgccatcaatgagggccagaacaagcccgagatcgaagtgacctgggccaagcagggaagaaccgagagactgtgtagccagaatcctcctgtgctgaagcggcaccagagagaaatcacccggaccacactgcagagcgaccaagaagagatcgattacgacgataccatcagcgtcgagatgaagaaagaagatttcgacatctacgacgaggacgagaatcagagccctcggagcttccagaagaaaaccaggcactactttattgccgccgtcgagcggctgtgggactacggaatgtctagctctcctcacgtgctgcggaatagagcccagtctggtagcgtgccccagttcaaaaaggtcgtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatctcctacgaagaggaccagagacagggcgcagagccccggaagaatttcgtgaagcccaacgagactaagacctacttttggaaggtgcagcaccatatggcccctacaaaggacgagttcgactgcaaagcctgggcctacttctccgatgtggacctcgaaaaggacgtgcacagcggactcatcggcccactgcttgtgtgccacaccaacacactgaaccccgctcacggcagacaagtgacagtgcaagagttcgccctgtttttcaccatcttcgacgaaacgaagtcctggtacttcaccgaaaacatggaaagaaactgcagggccccttgcaacattcagatggaagatcccaccttcaaagagaactaccggttccacgccatcaacggctacatcatggacacactgcccggcctggttatggcccaggatcagagaatccggtggtatctgctgtccatgggctccaacgagaatatccactccatccacttcagcggccacgtgttcaccgtgcggaaaaaagaagagtacaaaatggccctgtacaatctgtaccctggggtgttcgaaaccgttgagatgctgcctagcaaggccggaatttggagagtggaatgtctgattggagagcacctccacgccgggatgagcaccctgtttctggtgtactccaacaagtgtcagacccctctcggcatggcctctggccacattagagacttccagatcaccgccagcggacagtatggacagtgggcccctaaactggccagactgcactactccggcagcatcaatgcctggtccaccaaagagcctttcagctggatcaaagtggacctgctggctcccatgatcatccacggaatcaagacccagggcgccagacaaaagttcagcagcctgtacatcagccagttcatcatcatgtacagcctggacggaaagaagtggcagacctaccggggcaatagcaccggcacactgatggtgttcttcggcaacgtggactccagcggcattaagcacaacatcttcaaccctccaatcattgcccggtacatccggctgcaccccacacactacagcatcaggtctaccctgagaatggaactgatgggctgcgacctgaacagctgctctatgcccctcggaatggaaagcaaggccatcagcgacgcccagatcacagcctctagctacttcaccaacatgttcgccacttggagcccctctaaggcccggcttcatctgcaaggcagaagcaacgcttggaggccccaagtgaacaaccccaaagaatggctccaggtggactttcagaaaaccatgaaagtgacaggcgtgaccacacagggcgtcaagtccctgctgacctctatgtacgtgaaagagtttctgatcagctccagccaggacggccaccagtggaccctgttcttccagaacggcaaagtgaaagtgttccagggaaatcaggacagcttcacacccgtggtcaatagtctggacccaccactgctgacccgctacctgcgaattcaccctcagtcttgggtgcaccagattgccctgcggatggaagtgctgggctgtgaagctcaggacctctactag

SEQ ID NO: 392 - DNA, 4980 bp, Artificial Sequence
  Description of Artificial Sequence: Synthetic polynucleotide
atgcagatcgagctgtctacctgcttcttcctgtgcctgctgcggttctgcttcagcgccaccagaagatattacctgggcgccgtggaactgagctgggactacatgcagtctgacctgggagagctgcccgtggacgctagatttcctccaagagtgcccaagagcttccccttcaacacctccgtggtgtacaagaaaaccctgttcgtggaattcaccgaccacctgttcaatatcgccaagcctcggcctccttggatgggactgctgggacctacaattcaggccgaggtgtacgacaccgtggtcatcaccctgaagaacatggccagccatcctgtgtctctgcacgccgtgggagtgtcttattggaaggcttctgagggcgccgagtacgacgatcagacaagccagagagagaaagaggacgacaaggttttccctggcggcagccacacctatgtctggcaggtcctgaaagaaaacggccctatggcctccgatcctctgtgcctgacatacagctacctgagccacgtggacctggtcaaggacctgaattctggcctgatcggagccctgctcgtgtgtagagaaggcagcctggccaaagagaaaacccagacactgcacaagttcatcctgctgttcgccgtgttcgacgagggcaagagctggcacagcgagacaaagaacagcctgatgcaggacagggatgccgcctctgctagagcttggcctaagatgcacaccgtgaacggctacgtgaacagaagcctgcctggactgatcggctgccacagaaagtccgtgtactggcacgtgatcggcatgggcacaacacctgaggtgcacagcatctttctggaaggccacaccttcctcgtgcggaaccacagacaggccagcctggaaatcagccctatcaccttcctgaccgctcagaccctgctgatggatctgggccagtttctgctgttctgccacatcagctcccaccagcacgatggcatggaagcctacgtgaaggtggacagctgccccgaagaaccccagctgcggatgaagaacaacgaggaagccgaggactacgacgacgacctgaccgactctgagatggacgtcgtcagattcgacgacgataacagccccagcttcatccagatcagaagcgtggccaagaagcaccccaagacctgggtgcactatatcgccgccgaggaagaggactgggattacgctcctctggtgctggcccctgacgacagaagctacaagagccagtacctgaacaacggccctcagcggatcggccggaagtataagaaagtgcggttcatggcctacaccgacgagacattcaagaccagagaggccatccagcacgagagcggaattctgggccctctgctgtatggcgaagtgggcgatacactgctgatcatcttcaagaaccaggccagcagaccctacaacatctaccctcacggcatcaccgatgtgcggcccctgtattctagaaggctgcccaagggcgtgaagcacctgaaggacttccctatcctgcctggcgagattttcaagtacaagtggaccgtgaccgtggaagatggccccaccaagagcgaccctagatgtctgacacggtactacagcagcttcgtgaacatggaacgcgacctggccagcggcctgattggacctctgctgatctgctacaaagaaagcgtggaccagcggggcaaccagatcatgagcgacaagcggaacgtgatcctgtttagcgtgttcgatgagaaccggtcctggtatctgaccgagaacatccagcggtttctgcccaatcctgccggggtgcaactggaagatcctgagttccaggcaagcaacatcatgcactccatcaatggctatgtgttcgacagcctgcagctgagcgtgtgcctgcacgaagtggcctactggtacatcctgagcattggcgcccagaccgacttcctgtccgtgttctttagcggctacaccttcaagcacaagatggtgtacgaggataccctgacactgttcccattcagcggcgagacagtgttcatgagcatggaaaaccccggcctgtggattctgggctgtcacaacagcgacttccggaacagaggcatgacagccctgctgaaggtgtccagctgcgacaagaacaccggcgactactacgaggacagctatgaggacatcagcgcctacctgctgagcaagaacaatgccatcgagcccagaagcttcagccagaatagcagacacccctccaccagacagaagcagttcaacgccacaacaatccccgagaacgacatcgagaaaaccgatccttggtttgcccacagaacccctatgcctaagatccagaacgtgtcctccagcgatctgctgatgctcctgagacagagccctacacctcacggactgagcctgtccgatctgcaagaggccaaatacgaaaccttcagcgacgacccttctcctggcgccatcgacagcaacaatagcctgagcgagatgacccacttcagaccacagctgcaccacagcggcgacatggtgtttacacctgagagcggcctccagctgagactgaatgagaagctgggaaccaccgccgccaccgagctgaagaaactggacttcaaggtgtcctctaccagcaacaacctgatcagcacaatcccctccgacaacctggctgccggcaccgacaacacatcttctctgggcccacctagcatgcccgtgcactacgatagccagctggataccacactgttcggcaagaagtctagccctctgacagagtctggcggccctctgtctctgagcgaggaaaacaacgacagcaagctgcctcctgtgctgaagcggcaccagcgggaaatcaccagaaccacactgcagagcgaccaagaggaaatcgattacgacgacaccatcagcgtcgagatgaagaaagaagatttcgacatctacgacgaggacgagaatcagagccccagatcctttcagaaaaagacccggcactacttcattgccgccgtcgagagactgtgggactacggcatgtctagcagccctcacgtgctgagaaatagagcccagagcggcagcgtgccccagttcaagaaagtggtgttccaagagttcaccgacggcagcttcacccagccactgtatagaggcgagctgaacgagcatctgggcctgctgggcccttatatcagagccgaagtggaagataacatcatggtcaccttccggaatcaggctagccggccttacagcttctacagctccctgatctcctacgaagaggaccagagacagggcgctgagccccggaagaatttcgtgaagcccaacgagactaagacctacttttggaaggtgcagcaccacatggcccctacaaaggacgagttcgactgcaaagcctgggcctacttctccgatgtggatctggaaaaggacgtgcacagcgggctcatcggaccactgcttgtgtgccacaccaacacactgaaccccgctcacggcagacaagtgacagtgcaagagttcgccctgttcttcaccatcttcgacgaaacaaagagctggtacttcaccgagaatatggaacggaactgcagggccccttgcaacatccagatggaagatcccaccttcaaagagaactaccggttccacgccatcaacggctacatcatggacacactgcccggcctggttatggcccaggatcagagaatccggtggtatctgctgtccatgggctccaacgagaatatccacagcatccacttcagcggccacgtgttcaccgtgcggaaaaaagaagagtacaaaatggccctgtacaatctgtaccctggggtgttcgaaaccgtggaaatgctgccttccaaggccggcatttggagagtggaatgtctgattggagagcacctccacgccggaatgagcaccctgtttctggtgtactccaacaagtgtcagacccctctcggcatggcctctggacacatcagagacttccagatcaccgcctctggccagtacggacagtgggctcctaaactggctcggctgcactactccggcagcatcaatgcctggtccaccaaagagcccttcagctggatcaaggtggacctgctggctcccatgatcatccacggaatcaagacccagggcgcaagacagaagttcagcagcctgtacatcagccagttcatcatcatgtacagcctggacggaaagaagtggcagacctaccggggcaatagcaccggcacactcatggtgttcttcggcaacgtggactccagcggcattaagcacaacatcttcaaccctccaatcattgcccggtacatccggctgcaccccacacactacagcatccggtctaccctgagaatggaactgatgggctgcgacctgaacagctgctctatgcccctcggaatggaaagcaaggccatcagcgacgcccagatcacagccagcagctacttcaccaacatgttcgccacttggagcccctccaaggctagactgcatctgcagggcagaagcaacgcttggaggccccaagtgaacaaccccaaagagtggctgcaggttgactttcaaaagaccatgaaagtgaccggcgtgaccacacagggcgtcaagtctctgctgacctctatgtacgtgaaagagttcctgattagcagcagccaggacggccaccagtggaccctgtttttccagaacggcaaagtgaaagtgttccagggcaatcaggacagcttcacacccgtggtcaattctctggaccctccactgctgaccagatacctgcggattcaccctcagtcttgggtgcaccagatcgctctgcggatggaagtgctgggctgtgaagctcaggacctctactag

SEQ ID NO: 393 - DNA, 4374 bp, Artificial Sequence
  Description of Artificial Sequence: Synthetic polynucleotide
atgcagatagaattatctacttgtttttttctttgtctgctcaggttctgcttctctgctacaaggaggtattacttaggtgctgtagagttatcttgggactacatgcagtctgatcttggggagctccctgtggatgcaagatttccccctagagtacctaaaagtttccctttcaacacaagtgtggtgtataagaagactctgtttgttgagttcacagatcaccttttcaatattgccaagcccagacccccctggatgggtctactggggccaacaattcaagcagaggtatatgatacagtggtgatcacattaaagaacatggcatcccaccctgtaagcctgcatgctgttggtgtgtcctattggaaagcaagtgaaggtgctgaatatgatgatcaaacatcccaaagagagaaggaagatgacaaagtcttcccaggtggctctcacacctatgtgtggcaagtgctcaaggaaaatgggcctatggctagtgatccattgtgcctcacatatagctacctgtcccatgtggacttagttaaagatctgaactcaggtctgattggtgccctgctggtctgtagggaaggatcactagctaaagaaaaaacccagactttacacaagttcatcttattatttgctgtttttgatgagggaaagagctggcactcagagactaagaattcactcatgcaggatagagatgcagcttctgctagagcatggccaaaaatgcatactgtgaatgggtatgttaacaggagtctgcctggcctcataggctgccatagaaaatcagtgtactggcatgtcataggtatgggcactactcctgaggtgcattccatttttttggaggggcatactttccttgtaagaaaccacaggcaggcttcattggaaattagtccaataacctttctcacagcccagactctgctaatggacttggggcagtttttattattttgtcacattagctctcatcagcatgatggaatggaagcctatgttaaggttgattcctgcccagaagagccccagttgagaatgaagaacaatgaggaagcagaagactatgatgatgatctaacagactcagaaatggatgttgtgagatttgatgatgataactccccaagttttattcagatcaggtcagtggccaagaaacatccaaaaacatgggttcattatattgcagcagaagaagaagactgggattatgcacccttggtattagcccctgatgacagaagctataagtcacaatatctcaacaatggaccccagagaattggcagaaagtacaaaaaagtcaggtttatggcttatactgatgagactttcaaaactagagaggctattcaacatgaatctggcatcctaggtcctttgttatatggggaagtaggggacaccttattaattatatttaaaaaccaggccagtaggccttacaacatttacccccacggtataacagatgtcagaccactgtactcaaggaggctaccaaaaggggtgaagcacctaaaagacttccccatcctacctggtgagattttcaagtataagtggacagtgactgtagaagatggtccaaccaaatcagatcccagatgcctgacaaggtactacagtagctttgtaaatatggagagagacctggcctcagggttaatagggcccctactgatctgctacaaggagagtgtagaccaaagaggcaaccaaattatgtcagacaagagaaatgtcatcctctttagtgtttttgatgagaataggtcctggtacctgacagaaaatatccaaagattccttccaaatccagcaggggtacaactggaggaccctgagttccaggcctccaatatcatgcacagcatcaatggttatgtgtttgacagtttgcaactttcagtgtgccttcatgaggttgcatactggtatatactttctataggggcccagacagacttcttgtcagttttcttttcaggctatactttcaagcataagatggtatatgaagataccctgactctttttccctttagtggtgagacagttttcatgtcaatggaaaacccagggctttggatcttgggatgccacaactctgactttagaaacagaggcatgactgcccttttaaaggtgtcctcttgtgataagaatactggagactactatgaggacagctatgaggacatttcagcctatctgctgtcaaaaaataatgctatagagccaaggtcattttctcaaaatcctcctgtcctgaagaggcaccaaagagagataaccaggactaccttacagtctgaccaggaggaaattgattatgatgacacaataagtgtggagatgaaaaaggaggattttgatatttatgatgaggatgaaaaccaatctccaagatctttccagaagaagactagacactatttcattgctgcagtggaaagactgtgggactatggaatgtcctccagccctcatgttctcaggaatagggctcaaagtggttctgtgccacagttcaagaaggtggtgtttcaggaattcacagatgggtcctttactcaaccactgtataggggagaactcaatgaacatctaggattactaggtccctacattagagctgaggtggaggacaatatcatggtcactttcaggaaccaggcatctagaccatactctttttacagctccttgatatcttatgaagaggaccagagacagggtgcagaacccaggaagaactttgtgaaacccaatgagaccaaaacatacttctggaaggtccagcatcatatggctcctaccaaggatgaatttgactgcaaagcctgggcttacttctcagatgtggatttggagaaagatgtgcacagtggcttgattgggcctcttttggtatgtcataccaacaccttaaaccctgctcatggaagacaagtaacagtgcaagagtttgccctctttttcactatatttgatgagacaaaaagttggtactttactgagaatatggagaggaactgcagggctccctgcaatatacagatggaggatcctactttcaaggaaaactataggtttcatgccattaatggctatatcatggatacattgcctggcttagttatggcccaggatcagagaatcagatggtacctccttagtatgggaagcaatgaaaacatacattctattcacttcagtggacatgtctttactgtgagaaaaaaggaagagtacaagatggcactgtacaatctgtaccctggagtgtttgagacagttgagatgctgcccagcaaggctgggatctggagggtagaatgcctgattggagaacacttacatgcaggtatgtccactctattcttggtctattccaacaagtgtcagacccccctaggcatggcatctggccatattagagatttccagataactgcttctggtcagtatggccagtgggcccccaagcttgctagacttcactacagtggttcaataaatgcctggtccaccaaggagcccttcagctggattaaagtggacttgctagcccccatgatcattcatgggataaaaacacagggtgccagacagaaattttcatctctgtacatcagccagtttatcatcatgtacagtctggatggcaaaaaatggcagacctacagaggtaactctacaggtacactaatggtattttttggcaatgtagattcatcaggtatcaagcataatatctttaatcctcccattattgccagatacatcaggttgcacccaactcattacagtataagatccactttaaggatggagcttatggggtgtgaccttaatagctgcagtatgcccttgggaatggaaagtaaggccatatcagatgcccagattactgcaagcagctactttacaaacatgtttgcaacctggtctcctagtaaagccaggctgcacttgcagggtaggagcaatgcatggagaccccaggtcaataacccaaaagagtggcttcaagttgactttcaaaagacaatgaaggtaacaggggtaaccacccaaggggtaaagagtctgctgacatctatgtatgtaaaagaattcctcatctcaagtagtcaagatgggcaccagtggacactgttcttccagaatggaaaagttaaggtgttccaaggtaatcaagacagcttcactccagtggtgaacagtctggatccaccactcctaaccaggtacctgaggatccaccctcagtcctgggtccaccagatagctctgagaatggaagtgctgggctgtgaagctcaggacctatactga

SEQ ID NO: 394 - DNA, 7056 bp, Artificial Sequence
  Description of Artificial Sequence: Synthetic polynucleotide
atgcaaattgaattgagtacctgttttttcctctgtctattaaggttttgtttcagtgcaacaagaaggtattatctgggagctgttgagttatcctgggactacatgcagtctgacctgggagagctcccagtggatgctaggtttcccccaagagtacccaaaagcttccctttcaacacttctgttgtctataaaaagactctgtttgtagaattcacagatcatctgtttaacattgccaagcctagacctccatggatggggctgctgggaccaactattcaggcagaggtttatgacactgtggtgattacacttaagaatatggcatcccacccagtgagcctgcatgctgttggggtttcctactggaaggcaagtgaaggagctgagtatgatgaccagactagccaaagagagaaggaggatgacaaggtctttccaggtggcagccacacctatgtctggcaggtgctgaaggagaatggccctatggcctctgatcctttgtgtctaacctacagttatttgtctcatgtggacctggtgaaggaccttaactcagggctgataggggccttgctggtgtgtagggagggaagcctggctaaggaaaagacacagactctgcataagtttattctcttgtttgcagtgtttgatgagggtaaaagctggcactctgaaacaaaaaacagcttgatgcaggacagggatgctgccagtgctagggcttggcctaagatgcacacagtcaatggctatgttaacagatcactgcctggtttgattggctgccacagaaagtctgtttactggcatgtaattgggatggggacaaccccagaagttcactctatcttcctggaagggcacaccttcctggttagaaatcatagacaggcatccttagagatttctcctattacattcctgactgcccagaccctcctcatggacctgggtcagttcctgcttttttgccacatttcctcccaccagcatgatggcatggaggcctatgtgaaagttgattcttgccctgaggagcctcagcttaggatgaagaacaatgaagaggctgaggactatgatgatgacctaacagacagtgagatggatgttgtgaggtttgatgatgacaattcacctagtttcatccagattaggtctgtggctaagaaacatccaaagacctgggttcactacattgcagcagaggaggaggactgggattatgcccccctggttctggcacctgatgacagaagctataagtcccagtatctcaacaatggcccccagaggattggaagaaaatacaaaaaagtcagatttatggcctatacagatgagacttttaaaactagggaagctattcagcatgagtcagggatcctgggacctcttctttatggagaggtgggggacactcttctgataatttttaaaaatcaggcaagtagaccttataacatctacccccatgggatcactgatgtcaggcctctgtactcaagaaggctgcccaagggtgtcaaacacctcaaggatttccctattcttcctggggagatcttcaaatacaagtggacagttactgtggaggatggccccaccaaatctgacccaaggtgcctcaccagatattacagctcctttgtgaatatggaaagagacctagctagtggtctcattggcccactgctcatctgttacaaggagtcagtggaccagagagggaatcaaattatgtctgacaagagaaatgtgatccttttctcagtgtttgatgagaacagaagctggtatctgacagagaacattcaaaggtttctgccaaacccagctggagttcagctggaggaccctgaattccaggcatctaatattatgcattctatcaatggatatgtgtttgatagtctgcagctgtctgtgtgcctgcatgaagtggcctactggtatatcctctctattggtgcccagacagatttcttgtctgtgtttttcagtggttacacatttaaacataaaatggtgtatgaggacacacttacattattcccttttagtggagagacagtgtttatgtccatggagaatccaggcctgtggatcttggggtgtcataatagtgactttaggaatagaggtatgacagctctgctcaaagtgtcttcctgtgacaagaacacaggggactattatgaggactcttatgaggacatttcagcctatttactgtccaagaacaatgccattgaaccaagatctttctctcagaactcaagacaccccagcaccaggcagaagcagttcaatgcaaccaccatcccagagaatgatattgaaaaaactgacccttggtttgcccacaggactcccatgcctaagattcagaatgtatcttcatcagacttgctgatgctcctgagacagagcccaactcctcatggcctgagcttaagtgacctccaggaggctaagtatgaaactttctcagatgatcccagtcctggtgccattgattctaataattccctgtctgagatgacacacttcagaccccagctccaccactctggagatatggtctttactcctgaatcaggcctgcagctgaggctgaatgaaaagcttggcaccacagcagctactgaactgaaaaagctggattttaaagtgagctccacatccaacaacctgatttccactatcccctcagataacttggcagcagggactgataacacaagctcactgggtcccccttccatgcctgtccattatgatagtcagctggatactactctgtttggtaagaaatcctctcccctgactgaaagtggaggccctctttccctgtcagaggagaacaatgacagcaaactgttagagtctggactcatgaactcacaggaaagttcttggggcaagaatgtgtctagcactgagtctgggagactgtttaagggcaagagggcccatggaccagccctgctgacaaaggataatgcactgtttaaggtctcaatcagcctgttgaagaccaacaaaaccagtaataattctgcaacaaacaggaagacccacattgatggaccctctcttctcattgagaattccccttctgtctggcagaacatcttggaatcagatacagagttcaagaaggtgactcccctgatccatgataggatgctcatggataagaatgccacagcactcaggctcaatcacatgagcaacaagactacctcctccaaaaatatggagatggtgcagcagaagaaggaaggtcccattccccctgatgcacagaatccagatatgagcttctttaagatgctgtttttgcctgagtctgccaggtggattcagaggacacatgggaagaactcacttaactctggccaaggtcccagtcctaagcagttggtgagcttggggcctgagaaaagtgtggagggacagaatttcctgtctgaaaagaacaaagtggttgtgggcaaaggagagttcactaaagatgtgggactgaaggagatggtgtttcctagttcaagaaatctctttcttaccaatcttgataacctgcatgagaacaacacccacaatcaggaaaagaagatccaggaggaaattgagaagaaggaaaccctgatccaggaaaatgttgtgctgccacagatccacactgttactgggaccaaaaatttcatgaaaaacctgtttctcctgtctaccagacagaatgtagagggaagctatgatggggcctatgcccctgttctccaggacttcagatccctgaatgactccaccaacaggactaagaaacatactgcacactttagtaagaagggggaggaggagaacctggagggattgggaaaccagaccaagcagattgtggagaaatatgcttgcaccactagaatctcacctaacacaagccagcagaactttgtgacccagaggtctaagagggccctcaaacagtttagattgcctttggaggagactgagctggaaaagaggattattgtggatgacacctctacccagtggagcaagaatatgaagcacctgaccccaagcacccttactcagattgattacaatgaaaaagaaaagggtgccatcacccagagccccttgagtgactgtttgacaaggtcccacagtatcccacaggctaacagatctcctctgcctattgccaaggtcagctccttcccttccatcagacccatctatctgaccagagtgctgttccaggacaactcctctcatctgccagctgcctcctataggaagaaggatagtggtgtgcaggaatcatctcactttctgcagggagccaagaagaacaatctgagcctggcaattctcacacttgagatgacaggagaccagagggaagtgggaagtctgggcacttctgctaccaattctgtcacctacaagaaagtggagaatacagttctgcccaagccagacctgcctaaaacatctggaaaggttgagctgctgcctaaggtgcacatataccagaaggacctattccctacagagacatccaatggctccccaggccacctggacttggtagaggggtctctcctgcagggcactgaaggtgctatcaagtggaatgaggctaatagacctgggaaggtgccatttctgagggtggccacagagagctcagctaagacacccagcaagctgcttgatcccctggcctgggacaatcactatggaacccagattcctaaggaggagtggaagtcccaggagaagtccccagagaagactgctttcaagaagaaggacactatcctctccctgaatgcctgtgagtctaaccatgctattgctgccatcaatgaaggccagaacaagcctgaaattgaggtgacatgggccaagcagggcagaacagagaggctgtgcagccagaacccacctgtgctcaagaggcaccagagagagatcactagaaccactctgcagtcagaccaggaagagattgactatgatgacaccatctcagttgagatgaaaaaggaggattttgatatttatgatgaggatgagaatcaatccccaagatcttttcagaagaagacaagacattacttcattgctgcagtggagagactgtgggattatggcatgtcctcctcacctcatgtgctgagaaatagagcccagtctggctctgtgccccagttcaaaaaagtggtgtttcaggagttcacagatggttccttcacacagcccctgtacaggggtgagctgaatgagcacctggggttgctgggcccctacatcagagctgaagttgaggataatattatggtgaccttcaggaatcaggccagtaggccttactctttctactccagcctgatctcatatgaggaggaccagagacagggggctgaacctaggaagaattttgtgaagcccaatgaaacaaagacatacttctggaaggtgcagcaccacatggctcctaccaaggatgaatttgattgcaaggcttgggcctatttttctgatgtggacctggagaaggatgtgcattctggcctcattggccctctcttggtgtgtcacaccaataccttgaatccagcccatggcagacaggtgactgttcaggagtttgctctgtttttcaccatctttgatgagacaaagtcctggtattttacagagaatatggagaggaattgcagggccccctgcaacatccagatggaagacccaaccttcaaggagaactacagattccatgcaatcaatggatatatcatggacaccctgcctggcctggttatggctcaggatcagagaatcaggtggtatctgctgtctatggggtcaaatgagaacatccatagtatccacttctctggccatgtgtttacagtgagaaagaaggaagaatataagatggccctgtacaacctctaccctggagtgtttgaaactgttgaaatgctgccttcaaaggctggaatctggagggtggaatgcctgattggagagcaccttcatgctggcatgtccaccctgtttctggtgtacagcaataagtgtcagactcctctgggtatggcttcaggccacatcagggacttccagatcactgcctcaggacagtatggacagtgggctcccaaactggcaaggctccactactcaggcagcattaatgcctggtccaccaaagagcctttcagctggattaaggtggatctcctggcacctatgatcatccatgggatcaagactcagggagctaggcagaagtttagcagcctgtacatttctcagtttatcattatgtacagcctggatggaaaaaagtggcagacctatagaggaaactccactggaacactgatggtgttttttggcaatgtggactcaagtgggatcaagcacaatatcttcaacccccctatcattgccagatacatcaggctccaccctacacactactctatcagatctacacttaggatggagctgatgggatgtgatctgaactcttgcagtatgcctctgggtatggagtccaaggccatctctgatgctcagatcacagccagctcttactttactaatatgtttgctacctggtccccaagcaaggcaagactgcacctgcagggcagatccaatgcttggagaccccaggtgaataacccaaaagagtggcttcaggtggacttccagaagactatgaaggtgactggagtgaccacccagggggtgaagtcactgctgacctccatgtatgtgaaggagttcctgatctccagctcccaggatggccaccagtggaccctgttcttccagaatggaaaggtgaaggtgttccagggaaaccaggactcctttacccctgtggtgaactccctggaccccccactgctgaccagatacctgagaatccatccccagagctgggtgcaccagattgcccttaggatggaggtgctgggatgtgaagcccaggacctgtactaa

SEQ ID NO: 395 - DNA, 5013 bp, Artificial Sequence
  Description of Artificial Sequence: Synthetic polynucleotide
atgcaaattgagttaagtacctgttttttcctgtgcctgttgagattttgcttctctgctaccagaaggtattacctgggagctgtggagctgtcatgggactacatgcagtctgacctgggagagctccctgttgatgctaggtttccccctagggtgccaaagtcctttccttttaacacctcagtggtgtacaagaagacactgtttgtggagtttactgaccacctcttcaatattgctaagccaagacccccttggatgggtctcttgggccctaccatccaggctgaggtttatgatacagtggtgattaccctcaagaatatggcttctcatcctgttagtctgcatgcagtaggggtcagctattggaaggccagtgaaggagctgagtatgatgaccagaccagccagagagagaaagaggatgacaaggtgttccctgggggatcacacacctatgtgtggcaggtgttgaaggaaaatggacccatggcctctgacccactctgcctgacttactcctacctgtctcatgtggacctggtcaaagatctgaactctggcctgattggggcactgttggtgtgcagagaagggtctcttgccaaggagaagactcagaccctgcacaagttcatcctgctgtttgctgtgtttgatgaaggcaagtcttggcattctgagactaagaacagcctgatgcaagatagagatgctgcatctgccagggcctggcctaagatgcacactgtgaatggatatgtgaataggtccttgcctggcctgattggatgccataggaagtctgtgtactggcatgtgattggcatgggcaccacccctgaggttcactctatttttctggagggccatactttccttgtgaggaatcatagacaggcctctctggagattagccctattacatttctgactgctcagaccctcctcatggacttggggcagtttctgttattctgccacatcagcagccatcaacatgatggtatggaagcctatgtcaaagtggatagctgccctgaagaaccacagcttaggatgaagaacaatgaggaggcagaggactatgatgatgatctgactgattctgaaatggatgtggtgagatttgatgatgataatagcccttcctttatccagatcaggtcagtggccaagaagcacccaaagacctgggtgcattatattgctgctgaggaggaggactgggactatgcccctctggtgctggcccctgatgatagaagctataagtctcaatacttgaataatggcccacagaggattgggagaaagtacaaaaaggtgagatttatggcctacactgatgagactttcaagaccagagaggccatccagcatgaatcaggcattttgggtcccctgctgtatggagaggtgggggataccctgctgatcatctttaagaaccaggccagcagaccttacaacatttaccctcatgggatcacagatgtgaggccactctactctaggagattgcccaagggagtcaagcatcttaaggactttccaatcctgcctggggagatcttcaagtacaaatggacagtgacagttgaggatggacctactaagagtgaccccaggtgtctgaccagatattactctagctttgtcaatatggaaagagacctggcttcaggcttgataggccctcttctcatctgctacaaagagtctgtggaccagagaggaaatcagattatgtctgacaagagaaatgttattctgttttcagtctttgatgagaacagaagttggtacttgacagagaacattcagagatttctgcctaaccctgcaggagtgcagcttgaggaccctgagtttcaggcttccaatatcatgcattctatcaatggctatgtgtttgatagcctgcagctgtctgtgtgcctgcatgaggttgcctattggtacatcctgtctattggggcccaaactgatttcttgtctgtgtttttcagtggatatacctttaagcataagatggtgtatgaagataccttgacacttttccctttctcaggagagactgtcttcatgtctatggagaaccctggactgtggatcctgggatgccacaactcagacttcagaaacaggggtatgacagctctgcttaaggtctcctcatgtgacaaaaatacaggagactactatgaagattcctatgaggacatctctgcttacctgctcagcaaaaacaatgccattgagcccagaagcttcagccagaattccagacatcccagtactaggcagaagcagtttaatgccaccaccatcccagaaaatgacattgagaagacagacccttggtttgcccatagaaccccaatgcccaagattcagaatgtgagcagctcagacttgctgatgctgctgaggcagtctcctactccccatggcctgtccctctcagatctgcaggaagccaagtatgagacattttctgatgacccctccccaggggctattgacagtaacaacagcctgtctgaaatgacccacttcagacctcagctccaccacagtggggatatggtgtttaccccagagtcaggcctgcagctgagactgaatgagaagctgggaaccacagctgccacagaactgaagaagctggatttcaaggtgagctctacttcaaataatctgatttccactatcccatctgacaatttggcagctggcactgacaatacaagctctctgggcccacctagcatgccagtgcattatgacagccagttggacaccactctttttggaaagaaatccagtcccctgacagagtcaggaggacccctttctctgtctgaggagaacaatgatagtaagcttctggagtcaggcttgatgaactcccaggagagttcttggggcaagaatgtgagctctagggagatcaccagaaccactctgcagtctgaccaagaagagattgattatgatgacactatctctgttgagatgaagaaggaggactttgatatctatgatgaggatgagaaccagtctccaagaagtttccagaagaagaccaggcactactttattgctgctgtggagagactgtgggactatggaatgtcctcctcccctcatgtcctgagaaatagagctcagtcaggatcagtgccccagttcaagaaggtggtgttccaggaattcacagatggaagttttacccagccactgtatagaggtgaactgaatgaacatctgggtctgctggggccctatatcagggctgaggtggaggacaatattatggtgacctttagaaaccaggcctcaaggccctacagcttctactcttccctcatttcatatgaggaagaccagagacagggagcagagcctagaaagaactttgtcaagcccaatgaaaccaaaacctatttctggaaggtgcagcaccacatggcacccaccaaagatgagtttgactgcaaagcctgggcctatttctcagatgtggatctggagaaggatgtccattcaggtctgattggaccactcctggtgtgccacaccaacacactgaatccagctcatggcagacaggtgacagtccaggagtttgccctgtttttcactatttttgatgagaccaagagctggtattttacagagaatatggaaagaaactgcagagccccttgtaatatccagatggaggacccaacctttaaggagaactacaggttccatgccatcaatggctacattatggataccctgcctggcctggttatggcccaggatcagaggatcaggtggtatctgctgtcaatgggctccaatgagaacattcatagtattcacttttcaggacatgtgttcacagtgagaaagaaggaggagtataagatggccctctataatctctacccaggggtgtttgagacagttgagatgctgccatctaaggcaggcatctggagagtggaatgcctcattggagagcacctgcatgctggcatgtccaccctgtttctggtgtactccaacaaatgtcagacccctcttggtatggcctctggccacattagggatttccagattactgccagtggtcagtatgggcagtgggcccctaagctggccagactgcactattctgggagcatcaatgcctggtccaccaaggaacctttttcttggattaaagtggatctgctggccccaatgatcatccatgggatcaagacccagggagctaggcagaagttcagcagcctgtacattagtcagttcatcattatgtacagtctggatggcaaaaagtggcagacatacaggggcaattccactggaaccctgatggtgttctttggaaatgtggatagcagtggtatcaagcacaacattttcaaccctcccatcattgccaggtacatcagactgcatccaacccactacagcattaggagcacccttaggatggagctcatggggtgtgacctgaactcttgctctatgccacttggaatggagagcaaggccatctctgatgcccagattactgctagttcctacttcaccaatatgtttgccacctggtcacccagcaaggccaggctgcacctgcagggaaggtccaatgcttggaggcctcaggtgaacaatccaaaggagtggctgcaggtggacttccagaagactatgaaggtgacaggagtgaccactcagggagtgaagagcctgctgacctccatgtatgtgaaggagtttctgatctccagctcccaggatggccaccagtggaccctgttctttcagaatggcaaggtgaaggtgtttcaggggaatcaggactccttcaccccagtggtgaattccctggatccccctctgctgaccagatacctgagaatccacccccagtcttgggtgcaccagattgcccttaggatggaggtgctgggctgtgaggcccaggacctgtactga

SEQ ID NO: 396 - DNA, 5013 bp, Artificial Sequence
  Description of Artificial Sequence: Synthetic polynucleotide
atgcaaattgagttaagtacctgttttttcctgtgcctgttgagattttgcttctctgctaccagaaggtattacctgggagctgtggagctgtcatgggactacatgcagtctgacctgggagagctccctgttgatgctaggtttccccctagggtgccaaagtcctttccttttaacacctcagtggtgtacaagaagacactgtttgtggagtttactgaccacctcttcaatattgctaagccaagacccccttggatgggtctcttgggccctaccatccaggctgaggtttatgatacagtggtgattaccctcaagaatatggcttctcatcctgttagtctgcatgcagtaggggtcagctattggaaggccagtgaaggagctgagtatgatgaccagaccagccagagagagaaagaggatgacaaggtgttccctgggggatcacacacctatgtgtggcaggtgttgaaggaaaatggacccatggcctctgacccactctgcctgacttactcctacctgtctcatgtggacctggtcaaagatctgaactctggcctgattggggcactgttggtgtgcagagaagggtctcttgccaaggagaagactcagaccctgcacaagttcatcctgctgtttgctgtgtttgatgaaggcaagtcttggcattctgagactaagaacagcctgatgcaagatagagatgctgcatctgccagggcctggcctaagatgcacactgtgaatggatatgtgaataggtccttgcctggcctgattggatgccataggaagtctgtgtactggcatgtgattggcatgggcaccacccctgaggttcactctatttttctggagggccatactttccttgtgaggaatcatagacaggcctctctggagattagccctattacatttctgactgctcagaccctcctcatggacttggggcagtttctgttaagctgccacatcagcagccatcaacatgatggtatggaagcctatgtcaaagtggatagctgccctgaagaaccacagcttaggatgaagaacaatgaggaggcagaggactatgatgatgatctgactgattctgaaatggatgtggtgagatttgatgatgataatagcccttcctttatccagatcaggtcagtggccaagaagcacccaaagacctgggtgcattatattgctgctgaggaggaggactgggactatgcccctctggtgctggcccctgatgatagaagctataagtctcaatacttgaataatggcccacagaggattgggagaaagtacaaaaaggtgagatttatggcctacactgatgagactttcaagaccagagaggccatccagcatgaatcaggcattttgggtcccctgctgtatggagaggtgggggataccctgctgatcatctttaagaaccaggccagcagaccttacaacatttaccctcatgggatcacagatgtgaggccactctactctaggagattgcccaagggagtcaagcatcttaaggactttccaatcctgcctggggagatcttcaagtacaaatggacagtgacagttgaggatggacctactaagagtgaccccaggtgtctgaccagatattactctagctttgtcaatatggaaagagacctggcttcaggcttgataggccctcttctcatctgctacaaagagtctgtggaccagagaggaaatcagattatgtctgacaagagaaatgttattctgttttcagtctttgatgagaacagaagttggtacttgacagagaacattcagagatttctgcctaaccctgcaggagtgcagcttgaggaccctgagtttcaggcttccaatatcatgcattctatcaatggctatgtgtttgatagcctgcagctgtctgtgtgcctgcatgaggttgcctattggtacatcctgtctattggggcccaaactgatttcttgtctgtgtttttcagtggatatacctttaagcataagatggtgtatgaagataccttgacacttttccctttctcaggagagactgtcttcatgtctatggagaaccctggactgtggatcctgggatgccacaactcagacttcagaaacaggggtatgacagctctgcttaaggtctcctcatgtgacaaaaatacaggagactactatgaagattcctatgaggacatctctgcttacctgctcagcaaaaacaatgccattgagcccagaagcttcagccagaattccagacatcccagtactaggcagaagcagtttaatgccaccaccatcccagaaaatgacattgagaagacagacccttggtttgcccatagaaccccaatgcccaagattcagaatgtgagcagctcagacttgctgatgctgctgaggcagtctcctactccccatggcctgtccctctcagatctgcaggaagccaagtatgagacattttctgatgacccctccccaggggctattgacagtaacaacagcctgtctgaaatgacccacttcagacctcagctccaccacagtggggatatggtgtttaccccagagtcaggcctgcagctgagactgaatgagaagctgggaaccacagctgccacagaactgaagaagctggatttcaaggtgagctctacttcaaataatctgatttccactatcccatctgacaatttggcagctggcactgacaatacaagctctctgggcccacctagcatgccagtgcattatgacagccagttggacaccactctttttggaaagaaatccagtcccctgacagagtcaggaggacccctttctctgtctgaggagaacaatgatagtaagcttctggagtcaggcttgatgaactcccaggagagttcttggggcaagaatgtgagctctagggagatcaccagaaccactctgcagtctgaccaagaagagattgattatgatgacactatctctgttgagatgaagaaggaggactttgatatctatgatgaggatgagaaccagtctccaagaagtttccagaagaagaccaggcactactttattgctgctgtggagagactgtgggactatggaatgtcctcctcccctcatgtcctgagaaatagagctcagtcaggatcagtgccccagttcaagaaggtggtgttccaggaattcacagatggaagttttacccagccactgtatagaggtgaactgaatgaacatctgggtctgctggggccctatatcagggctgaggtggaggacaatattatggtgacctttagaaaccaggcctcaaggccctacagcttctactcttccctcatttcatatgaggaagaccagagacagggagcagagcctagaaagaactttgtcaagcccaatgaaaccaaaacctatttctggaaggtgcagcaccacatggcacccaccaaagatgagtttgactgcaaagcctgggcctatttctcagatgtggatctggagaaggatgtccattcaggtctgattggaccactcctggtgtgccacaccaacacactgaatccagctcatggcagacaggtgacagtccaggagtttgccctgtttttcactatttttgatgagaccaagagctggtattttacagagaatatggaaagaaactgcagagccccttgtaatatccagatggaggacccaacctttaaggagaactacaggttccatgccatcaatggctacattatggataccctgcctggcctggttatggcccaggatcagaggatcaggtggtatctgctgtcaatgggctccaatgagaacattcatagtattcacttttcaggacatgtgttcacagtgagaaagaaggaggagtataagatggccctctataatctctacccaggggtgtttgagacagttgagatgctgccatctaaggcaggcatctggagagtggaatgcctcattggagagcacctgcatgctggcatgtccaccctgtttctggtgtactccaacaaatgtcagacccctcttggtatggcctctggccacattagggatttccagattactgccagtggtcagtatgggcagtgggcccctaagctggccagactgcactattctgggagcatcaatgcctggtccaccaaggaacctttttcttggattaaagtggatctgctggccccaatgatcatccatgggatcaagacccagggagctaggcagaagttcagcagcctgtacattagtcagttcatcattatgtacagtctggatggcaaaaagtggcagacatacaggggcaattccactggaaccctgatggtgttctttggaaatgtggatagcagtggtatcaagcacaacattttcaaccctcccatcattgccaggtacatcagactgcatccaacccactacagcattaggagcacccttaggatggagctcatggggtgtgacctgaactcttgctctatgccacttggaatggagagcaaggccatctctgatgcccagattactgctagttcctacttcaccaatatgtttgccacctggtcacccagcaaggccaggctgcacctgcagggaaggtccaatgcttggaggcctcaggtgaacaatccaaaggagtggctgcaggtggacttccagaagactatgaaggtgacaggagtgaccactcagggagtgaagagcctgctgacctccatgtatgtgaaggagtttctgatctccagctcccaggatggccaccagtggaccctgttctttcagaatggcaaggtgaaggtgtttcaggggaatcaggactccttcaccccagtggtgaattccctggatccccctctgctgaccagatacctgagaatccacccccagtcttgggtgcaccagattgcccttaggatggaggtgctgggctgtgaggcccaggacctgtactga

SEQ ID NO: 397 - protein, 1670 aa, Artificial Sequence
  Description of Artificial Sequence: Synthetic polypeptide
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLSCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 398 - protein, 31 aa, Artificial Sequence
  Description of Artificial Sequence: Synthetic polypeptide
SFSQNATNVSNNSNTSNDSNVSPPVLKRHQR

The invention claimed is:

1. A capsid-free closed-ended DNA (ceDNA) vector comprising: at least one nucleotide sequence positioned between flanking inverted terminal repeats (ITRs), wherein the at least one nucleotide sequence encodes at least one Factor VIII (FVIII) protein, wherein the least one nucleotide sequence that encodes the at least one FVIII protein has at least 90% identity to SEQ ID NO: 395.

2. The ceDNA vector of claim 1, wherein the ceDNA vector comprises a nucleotide sequence that is at least 85% identical to SEQ ID NO: 214.

3. The ceDNA vector of claim 1, wherein the ceDNA vector comprises:

a promoter linked to the at least one nucleotide sequence that encodes the at least one FVIII protein;

an enhancer;

a 5' UTR and/or intron sequence;

a 3' UTR sequence; and/or at least one poly A sequence.

4. The ceDNA vector of claim 1, wherein:

at least one of the flanking ITRs comprises a functional terminal resolution site and a Rep binding site;

one or both of the flanking ITRs are derived from a virus selected from the group consisting of a parvovirus, a dependovirus, and an adeno-associated virus (AAV);

the flanking ITRs are symmetric;

the flanking ITRs are substantially symmetric;

the flanking ITRs are asymmetric;

one of the flanking ITRs is a wild-type ITR, or both of the flanking ITRs are wild-type ITRs;

the flanking ITRs are derived from different viral serotypes;

the flanking ITRs are derived from a pair of viral serotypes selected from the group consisting of AAV1 and AAV1, AAV1 and AAV2, AAV1 and AAV3, AAV1 and AAV4, AAV1 and AAV5, AAV1 and AAV6, AAV1 and AAV7, AAV1 and AAV8, AAV1 and AAV9, AAV1 and AAV10, AAV1 and AAV11, AAV1 and AAV12, AAV1 and AAVRH8, AAV1 and AAVRH10, AAV1 and AAV13, AAV1 and AAVDJ, AAV1 and AAVDJ8, AAV1 and AVIAN, AAV1 and CANINE, AAV1 and EQUINE, AAV1 and GOAT, AAV1 and SHRIMP, AAV1 and PORCINE, AAV1 and INSECT, AAV1 and OVINE, AAV1 and B19, AAV1 and MVM, AAV1 and GOOSE, AAV1 and SNAKE, AAV2 and AAV2, AAV2 and AAV3, AAV2 and AAV4, AAV2 and AAV5, AAV2 and AAV6, AAV2 and AAV7, AAV2 and AAV8, AAV2 and AAV9, AAV2 and AAV10, AAV2 and AAV11, AAV2 and AAV12, AAV2 and AAVRH8, AAV2 and AAVRH10, AAV2 and AAV13, AAV2 and AAVDJ, AAV2 and AAVDJ8, AAV2 and AVIAN, AAV2 and CANINE, AAV2 and EQUINE, AAV2 and GOAT, AAV2 and SHRIMP, AAV2 and PORCINE, AAV2 and INSECT, AAV2 and OVINE, AAV2 and B19, AAV2 and MVM, AAV2 and GOOSE, AAV2 and SNAKE, AAV3 and AAV3, AAV3 and AAV4, AAV3 and AAV5, AAV3 and AAV6, AAV3 and AAV7, AAV3 and AAV8, AAV3 and AAV9, AAV3 and AAV10, AAV3 and AAV11, AAV3 and AAV12, AAV3 and AAVRH8, AAV3 and AAVRH10, AAV3 and AAV13, AAV3 and AAVDJ, AAV3 and AAVDJ8, AAV3 and AVIAN, AAV3 and CANINE, AAV3 and EQUINE, AAV3 and GOAT, AAV3 and SHRIMP, AAV3 and PORCINE, AAV3 and INSECT, AAV3 and OVINE, AAV3 and B19, AAV3 and MVM, AAV3 and GOOSE, AAV3 and SNAKE, AAV4 and AAV4, AAV4 and AAV5, AAV4 and AAV6, AAV4 and AAV7, AAV4 and AAV8, AAV4 and AAV9, AAV4 and AAV10, AAV4 and AAV11, AAV4 and AAV12, AAV4 and AAVRH8, AAV4 and AAVRH10, AAV4 and AAV13, AAV4 and AAVDJ, AAV4 and AAVDJ8, AAV4 and AVIAN, AAV4 and CANINE, AAV4 and EQUINE, AAV4 and GOAT, AAV4 and SHRIMP, AAV4 and PORCINE, AAV4 and INSECT, AAV4 and OVINE, AAV4 and B19, AAV4 and MVM, AAV4 and GOOSE, AAV4 and SNAKE, AAV5 and AAV5, AAV5 and AAV6, AAV5 and AAV7, AAV5 and AAV8, AAV5 and AAV9, AAV5 and AAV10, AAV5 and AAV11, AAV5 and AAV12, AAV5 and AAVRH8, AAV5 and AAVRH10, AAV5 and AAV13, AAV5 and AAVDJ, AAV5 and AAVDJ8, AAV5 and AVIAN, AAV5 and CANINE, AAV5 and EQUINE, AAV5 and GOAT, AAV5 and SHRIMP, AAV5 and PORCINE, AAV5 and INSECT, AAV5 and OVINE, AAV5 and B19, AAV5 and MVM, AAV5 and GOOSE, AAV5 and SNAKE, AAV6 and AAV6, AAV6 and AAV7, AAV6 and AAV8, AAV6 and AAV9, AAV6 and AAV10, AAV6 and AAV11, AAV6 and AAV12, AAV6 and AAVRH8, AAV6 and AAVRH10, AAV6 and AAV13, AAV6 and AAVDJ, AAV6 and AAVDJ8, AAV6 and AVIAN, AAV6 and CANINE, AAV6 and EQUINE, AAV6 and GOAT, AAV6 and SHRIMP, AAV6 and PORCINE, AAV6 and INSECT, AAV6 and OVINE, AAV6 and B19, AAV6 and MVM, AAV6 and GOOSE, AAV6 and SNAKE, AAV7 and AAV7, AAV7 and AAV8, AAV7 and AAV9, AAV7 and AAV10, AAV7 and AAV11, AAV7 and AAV12, AAV7 and AAVRH8, AAV7 and AAVRH10, AAV7 and AAV13, AAV7 and AAVDJ, AAV7 and AAVDJ8, AAV7 and AVIAN, AAV7 and CANINE, AAV7 and EQUINE, AAV7 and GOAT, AAV7 and SHRIMP, AAV7 and PORCINE, AAV7 and INSECT, AAV7 and OVINE, AAV7 and B19, AAV7 and MVM, AAV7 and GOOSE, AAV7 and SNAKE, AAV8 and AAV8, AAV8 and AAV9, AAV8 and AAV10, AAV8 and AAV11, AAV8 and AAV12, AAV8 and AAVRH8, AAV8 and AAVRH10, AAV8 and AAV13, AAV8 and AAVDJ, AAV8 and AAVDJ8, AAV8 and AVIAN, AAV8 and CANINE, AAV8 and EQUINE, AAV8 and GOAT, AAV8 and SHRIMP, AAV8 and PORCINE, AAV8 and INSECT, AAV8 and OVINE, AAV8 and B19, AAV8 and MVM, AAV8 and GOOSE, AAV8 and SNAKE, AAV9 and AAV9, AAV9 and AAV10, AAV9 and AAV11, AAV9 and AAV12, AAV9 and AAVRH8, AAV9 and AAVRH10, AAV9 and AAV13, AAV9 and AAVDJ, AAV9 and AAVDJ8, AAV9 and AVIAN, AAV9 and CANINE, AAV9 and EQUINE, AAV9 and GOAT, AAV9 and SHRIMP, AAV9 and PORCINE, AAV9 and INSECT, AAV9 and OVINE, AAV9 and B19, AAV9 and MVM, AAV9 and GOOSE, AAV9 and SNAKE, AAV10 and AAV10, AAV10 and AAV11, AAV10 and AAV12, AAV10 and AAVRH8, AAV10 and AAVRH10, AAV10 and AAV13, AAV10 and AAVDJ, AAV10 and AAVDJ8, AAV10 and AVIAN, AAV10 and CANINE, AAV10 and EQUINE, AAV10 and GOAT, AAV10 and SHRIMP, AAV10 and PORCINE, AAV10 and INSECT, AAV10 and OVINE, AAV10 and B19, AAV10 and MVM, AAV10 and GOOSE, AAV10 and SNAKE, AAV11 and AAV11, AAV11 and AAV12, AAV11 and AAVRH8, AAV11 and AAVRH10, AAV11 and AAV13, AAV11 and AAVDJ, AAV11 and AAVDJ8, AAV11 and AVIAN, AAV11 and CANINE, AAV11 and EQUINE, AAV11 and GOAT, AAV11 and SHRIMP, AAV11 and PORCINE, AAV11 and INSECT, AAV11 and OVINE, AAV11 and B19, AAV11 and MVM, AAV11 and GOOSE, AAV11 and SNAKE, AAV12 and AAV12, AAV12 and AAVRH8, AAV12 and AAVRH10, AAV12 and AAV13, AAV12 and AAVDJ, AAV12 and AAVDJ8, AAV12 and AVIAN, AAV12 and CANINE, AAV12 and EQUINE, AAV12 and GOAT, AAV12 and SHRIMP, AAV12 and PORCINE, AAV12 and INSECT, AAV12 and OVINE, AAV12 and B19, AAV12 and MVM, AAV12 and GOOSE, AAV12 and SNAKE, AAVRH8 and AAVRH8, AAVRH8 and AAVRH10, AAVRH8 and AAV13, AAVRH8 and AAVDJ, AAVRH8 and AAVDJ8, AAVRH8 and AVIAN, AAVRH8 and CANINE, AAVRH8 and EQUINE, AAVRH8 and GOAT, AAVRH8 and SHRIMP, AAVRH8 and PORCINE, AAVRH8 and INSECT, AAVRH8 and OVINE, AAVRH8 and B19, AAVRH8 and MVM, AAVRH8 and GOOSE, AAVRH8 and SNAKE, AAVRH10 and AAVRH10, AAVRH10 and AAV13, AAVRH10 and AAVDJ, AAVRH10 and AAVDJ8, AAVRH10 and AVIAN, AAVRH10 and CANINE, AAVRH10 and EQUINE, AAVRH10 and GOAT, AAVRH10 and SHRIMP, AAVRH10 and PORCINE, AAVRH10 and INSECT, AAVRH10 and OVINE, AAVRH10 and B19, AAVRH10 and MVM, AAVRH10 and GOOSE, AAVRH10 and SNAKE, AAV13 and AAV13, AAV13 and AAVDJ, AAV13 and AAVDJ8, AAV13 and AVIAN, AAV13 and CANINE, AAV13 and EQUINE, AAV13 and GOAT, AAV13 and SHRIMP, AAV13 and PORCINE, AAV13 and INSECT, AAV13 and OVINE, AAV13 and B19, AAV13 and MVM, AAV13 and GOOSE, AAV13 and SNAKE, AAVDJ and AAVDJ, AAVDJ and AAVDJ8, AAVDJ and AVIAN, AAVDJ and CANINE, AAVDJ and EQUINE, AAVDJ and GOAT, AAVDJ and SHRIMP, AAVDJ and PORCINE, AAVDJ and INSECT, AAVDJ and OVINE, AAVDJ and B19, AAVDJ and MVM, AAVDJ and GOOSE, AAVDJ and SNAKE, AAVDJ8 and AAVDJ8, AAVDJ8 and AVIAN, AAVDJ8 and CANINE, AAVDJ8 and EQUINE, AAVDJ8 and GOAT, AAVDJ8 and SHRIMP, AAVDJ8 and PORCINE, AAVDJ8 and INSECT, AAVDJ8 and OVINE, AAVDJ8 and B19, AAVDJ8 and MVM, AAVDJ8 and GOOSE, AAVDJ8 and SNAKE, AVIAN and AVIAN, AVIAN and CANINE, AVIAN and EQUINE, AVIAN and GOAT, AVIAN and SHRIMP, AVIAN and PORCINE, AVIAN and INSECT, AVIAN and OVINE, AVIAN and B19, AVIAN and MVM, AVIAN and GOOSE, AVIAN and SNAKE, CANINE and CANINE, CANINE and EQUINE, CANINE and GOAT, CANINE and SHRIMP, CANINE and PORCINE, CANINE and INSECT, CANINE and OVINE, CANINE and B19, CANINE and MVM, CANINE and GOOSE, CANINE and SNAKE, EQUINE and EQUINE, EQUINE and GOAT, EQUINE and SHRIMP, EQUINE and PORCINE, EQUINE and INSECT, EQUINE and OVINE, EQUINE and B19, EQUINE and MVM, EQUINE and GOOSE, EQUINE and SNAKE, GOAT and GOAT, GOAT and SHRIMP, GOAT and PORCINE, GOAT and INSECT, GOAT and OVINE, GOAT and B19, GOAT and MVM, GOAT and GOOSE, GOAT and SNAKE, SHRIMP and SHRIMP, SHRIMP and PORCINE, SHRIMP and INSECT, SHRIMP and OVINE, SHRIMP and B19, SHRIMP and MVM, SHRIMP and GOOSE, SHRIMP and SNAKE, PORCINE and PORCINE, PORCINE and INSECT, PORCINE and OVINE, PORCINE and B19, PORCINE and MVM, PORCINE and GOOSE, PORCINE and SNAKE, INSECT and INSECT, INSECT and OVINE, INSECT and B19, INSECT and MVM, INSECT and GOOSE, INSECT and SNAKE, OVINE and OVINE, OVINE and B19, OVINE and MVM, OVINE and GOOSE, OVINE and SNAKE, B19 and B19, B19 and MVM, B19 and GOOSE, B19 and SNAKE, MVM and MVM, MVM and GOOSE, MVM and SNAKE, GOOSE and GOOSE, GOOSE and SNAKE, SNAKE and SNAKE;

one or both of the flanking ITRs comprise a sequence selected from the group consisting of SEQ ID NOs: 1, 2, and 5-48;

at least one of the flanking ITRs is altered from a wild-type AAV ITR sequence by a deletion, an addition, and/or a substitution that affects the overall three-dimensional conformation of the ITR;

one or both of the flanking ITRs are derived from an AAV serotype selected from the group consisting of: AAV1, AAV2, AAV3, AAV4, AAV5, AAV6, AAV7, AAV8, AAV9, AAV10, AAV11, and AAV12; and/or one of the flanking ITRs is not a wild-type ITR, or both of the ITRs are not wild-type ITRs.

5. The ceDNA vector of claim 1, wherein:

one or both of the flanking ITRs is modified by a deletion, an insertion, and/or a substitution in at least one of the ITR regions selected from the group consisting of: the A, A', B, B', C, C', D, and D' regions;

one or both of the flanking ITRs is modified by a deletion, an insertion, and/or a substitution in at least one of the ITR regions selected from the group consisting of: the A, A', B, B', C, C', D, and D' regions, wherein the deletion, the insertion, and/or the substitution results in the deletion of all or part of a stem-loop structure formed by the A, A', B, B' C, and/or C' regions;

one or both of the flanking ITRs are modified by a deletion, an insertion, and/or a substitution that results in the deletion of all or part of a stem-loop structure formed by the B and B' regions;

one or both of the flanking ITRs are modified by a deletion, an insertion, and/or a substitution that results in the deletion of all or part of a stem-loop structure formed by the C and C' regions;

one or both of the flanking ITRs are modified by a deletion, an insertion, and/or a substitution that results in the deletion of all or part of a stem-loop structure formed by the B and B' regions and/or all or part of a stem-loop structure normally formed by the C and C' regions;

one or both of the flanking ITRs comprise a single stem-loop structure in the region that, in a wild-type ITR, would comprise a first stem-loop structure formed by the B and B' regions and a second stem-loop structure formed by the C and C' regions;

one or both of the flanking ITRs comprise a single stem and two loops in the region that, in a wild-type ITR, would comprise a first stem-loop structure formed by the B and B' regions and a second stem-loop structure formed by the C and C' regions;

one or both of the flanking ITRs comprise a single stem and a single loop in the region that, in a wild-type ITR, would comprise a first stem-loop structure formed by the B and B' regions and a second stem-loop structure formed by the C and C' regions; and/or both flanking ITRs are altered in a manner that results in an overall three-dimensional symmetry when the flanking ITRs are inverted relative to each other.

6. The ceDNA vector of claim 1, further comprising at least one regulatory switch.

7. A method of expressing an FVIII protein in a cell comprising contacting the cell with the ceDNA vector of claim 1, wherein the cell is in vitro or in vivo.

8. The method of claim 7, wherein the cell is a liver cell.

9. A method of treating a subject with hemophilia A, comprising administering to the subject the ceDNA vector of claim 1, wherein the at least one nucleotide sequence encodes at least one FVIII protein.

10. The method of claim 9, wherein the ceDNA vector is delivered to a liver cell.

11. The method of claim 9, wherein the ceDNA vector is administered by a route selected from the group consisting of: intravenous injection, intramuscular injection, and infusion.

12. A pharmaceutical composition comprising the ceDNA vector of claim 1.

13. An isolated cell containing the ceDNA vector of claim 1.

14. A composition comprising the ceDNA vector of claim 1 and a lipid nanoparticle (LNP).

15. A kit comprising the ceDNA vector of claim 1.

16. The ceDNA vector of claim 1, wherein one or both of the flanking ITRs are synthetic.

17. The ceDNA vector of claim 1, wherein the at least one nucleotide sequence comprises SEQ ID NO: 395.

* * * * *